US007863021B2

(12) United States Patent
Schrodi et al.

(10) Patent No.: US 7,863,021 B2
(45) Date of Patent: Jan. 4, 2011

(54) GENETIC POLYMORPHISMS ASSOCIATED WITH RHEUMATOID ARTHRITIS, METHODS OF DETECTION AND USES THEREOF

(75) Inventors: Steven J. Schrodi, Livermore, CA (US); Ann B. Bogovich, El Cerrito, CA (US)

(73) Assignee: Celera Corporation, Alameda, CA (US)

( * ) Notice: Subject to any disclaimer, the term of this patent is extended or adjusted under 35 U.S.C. 154(b) by 196 days.

(21) Appl. No.: 12/231,877

(22) Filed: Sep. 4, 2008

(65) Prior Publication Data

US 2009/0162346 A1   Jun. 25, 2009

Related U.S. Application Data

(60) Provisional application No. 60/935,887, filed on Sep. 5, 2007.

(51) Int. Cl.
  *C12P 19/24* (2006.01)
  *C12Q 1/68* (2006.01)
  *C07H 21/02* (2006.01)
  *C07H 21/04* (2006.01)

(52) U.S. Cl. ............. 435/91.1; 435/6; 536/23.1; 536/24.33

(58) Field of Classification Search ............. None
  See application file for complete search history.

(56) References Cited

U.S. PATENT DOCUMENTS 6,673,908 B1   1/2004   Stanton et al.
2007/0031846 A1   2/2007   Cargill et al.

FOREIGN PATENT DOCUMENTS

WO   01/57182 A2   8/2001

OTHER PUBLICATIONS

Chang, M., et al., "A Large-Scale Rheumatoid Arthritis Genetic Study Identifies Association at Chromosome 9q33.2," PLOS Genetics, Jun. 2008, vol. 4, Issue 6, e1000107, 17 pgs.
Han, T., et al., "TRAF1 Polymorphisms Associated with Rheumatoid Arthritis Susceptibility in Asians and in Caucasians," Arthritis & Rheumatism, Jun. 2009, vol. 60, No. 9, pp. 2577-2584.
International Preliminary Report on Patentability, issued for PCT/US2008/100439, dated Mar. 18, 2010.
NCBI refSNP ID: rs2109895. May 2, 2006 [online], [retrieved on Mar. 24, 2009 from the internet <URL:http//www.ncbi.nlm.nih.gov/SNP/snp_ref.cgi?rs=2109895>; p. 1-ref SNPID; also see 3' and 5' flanking sequences on p. 1 submitter records.
NCBI refSNP ID: rs2239657. May 2, 2006 [online], [retrieved on Mar. 24, 2009 from the internet <URL:http//www.ncbi.nlm.nih.gov/SNP/snp_ref.cgi?rs=2239657>; p. 1-ref SNPID; also see 3' and 5' flanking sequences on p. 1 submitter records, RefSNP Alleles.
NCBI refSNP ID: rs7021880. May 2, 2006 [online], [retrieved on Mar. 24, 2009 from the internet <URL:http//www.ncbi.nlm.nih.gov/SNP/snp_ref.cgi?rs=7021880>; p. 1-ref SNIPID; also see 3' and 5' flanking sequences on p. 1 submitter records, RefSNP Alleles.
NCBI refSNP ID: rs7021049. May 2, 2006 [online ], [retrieved on Mar. 24, 2009 from the internet <URL:http//www.ncbi.nlm.nih.gov/SNP/snp_ref.cgi?rs=7021049>; p. 1-ref SNPID; also see 3' and 5' flanking sequences on p. 1 submitter records, RefSNP Alleles.
International Search Report and Written Opinion, dated Apr. 28, 2009, 15 pages.

*Primary Examiner*—Sarae Bausch

(57) ABSTRACT

The present invention provides compositions and methods based on genetic polymorphisms that are associated with autoimmune disease, particularly rheumatoid arthritis. For example, the present invention relates to nucleic acid molecules containing the polymorphisms, variant proteins encoded by these nucleic acid molecules, reagents for detecting the polymorphic nucleic acid molecules and variant proteins, and methods of using the nucleic acid molecules and proteins as well as methods of using reagents for their detection.

31 Claims, 1 Drawing Sheet

GENETIC POLYMORPHISMS ASSOCIATED WITH RHEUMATOID ARTHRITIS, METHODS OF DETECTION AND USES THEREOF

FIELD OF THE INVENTION

The present invention is in the field of autoimmune disease, particularly rheumatoid arthritis (RA). In particular, the present invention relates to specific single nucleotide polymorphisms (SNPs) in the human genome, and their association with autoimmune disease, particularly RA. The SNPs disclosed herein can be used as targets for the design of diagnostic reagents and the development of therapeutic agents, as well as for disease association and linkage analysis. In particular, the SNPs of the present invention are useful for such uses as identifying an individual who has an increased or decreased risk of developing autoimmune disease (particularly RA), for early detection of the disease, for providing clinically important information for the prevention and/or treatment of autoimmune disease, for predicting progression or recurrence of autoimmune disease, for predicting the seriousness or consequences of autoimmune disease in an individual, for determining the prognosis of an individual's recovery from autoimmune disease, for screening and selecting therapeutic agents, and for predicting a patient's response to therapeutic agents such as evaluating the likelihood of an individual responding positively to tumor necrosis factor (TNF) inhibitors, particularly for the treatment or prevention of autoimmune disease (such as RA). The SNPs disclosed herein are also useful for human identification applications. Methods, assays, kits, and reagents for detecting the presence of these polymorphisms and their encoded products are provided.

BACKGROUND OF THE INVENTION

Autoimmune Diseases & Rheumatoid Arthritis (RA)

Autoimmune diseases are a major health issue, occurring in up to 3% of the general population (Cooper & Stroehla, 2003, *Autoimmunity Rev.* 2:119-125). Although the clinical phenotypes of these diseases are distinct, they share certain common elements, including geographical distributions, population frequencies, therapeutic strategies, and some clinical features which suggest potential similarities in the underlying mechanisms of these diseases. Furthermore, the aggregation of multiple autoimmune diseases in the same individual or family supports the presence of common environmental and genetic factors that predispose an individual to autoimmunity (Vyse & Todd, 1996, *Cell* 85:311-318; Cooper & Stroehla, 2003, *Autoimmunity Rev.* 2:119-125; Ueda et al., 2003, *Nature* 423:506-511).

Inflammatory disorders are related to autoimmune disease. Examples of autoimmune and inflammatory diseases include rheumatoid arthritis, type 1 diabetes, multiple sclerosis, systemic lupus erythematosus, inflammatory bowel diseases, psoriasis, thyroiditis, celiac disease, pernicious anemia, asthma, vitiligo, glomerulonephritis, Graves' disease, myocarditis, Sjogren disease, and primary systemic vasculitis.

Rheumatoid arthritis (RA) is one of the most common autoimmune diseases, with a prevalence of between 0.5-1% in most adult populations. It is found worldwide and affects all ethnic groups, although it is more common in Europe and the United States than in Asia (Abdel-Nasser et al., 1997, *Semin. Arthritis Rheum.* 27:123-140; Silman & Hochberg, 1993, Rheumatoid Arthritis, *Epidemiology of the Rheumatic Diseases*, Oxford University Press, pp. 7-68) and there is a gradient in Europe with a higher prevalence in the north (Cimmino et al., 1998, *Ann. Rheum. Diseases* 57:315-318). RA can also occur in any age group. Onset is typically between the ages of 40 and 60 years, and the incidence increases with age until approximately 70-80 years, at which point it declines (Abdel-Nasser et al., 1997, *Semin. Arthritis Rheum.* 27: 123-140; Silman & Hochberg, 1993, *Epidemiology of the Rheumatic Diseases*. Oxford University Press. pp. 7-68). RA is two to three times more common in women than men, depending on age (Linos et al., 1980, *J. Chronic Diseases* 33:73-77). The observations that (i) women in the postpartum period are at increased risk for RA onset and (ii) women with RA commonly experience remission during pregnancy followed by postpartum relapse (Barrett et al., 1999, *Arthritis Rheum.* 42:1219-1227) suggest that hormones play a role in disease onset.

RA is a chronic, progressive disease characterized by the infiltration of activated lymphocytes and macrophages into the synovial lining of the affected joint. These cells produce cytokines and degradative enzymes, which mediate inflammation and destruction of the joint architecture, often leading to permanent disability. RA is a systemic disease; extra-articular manifestations are often present and can range from relatively minor problems, such as rheumatoid nodules, to life-threatening organ disease.

Clinically, RA varies from a very mild to a severely disabling disease with upwards of one in 20 patients progressing to severe, erosive disease. Joint damage occurs early in disease with the greatest progression to joint abnormalities taking place during the first six years. Within three years of disease onset, as many as 70% of patients show some radiographic evidence of joint damage (Lipsky et al., 1994, Rheumatoid Arthritis, *Harrison's Principles of Internal Medicine*, 13th ed. New York, McGraw-Hill, Inc., pp. 1648-1655). At present, there is no cure for RA, and the joint damage is irreversible.

Although the course of RA is highly variable, most patients with clinical, persistent RA eventually develop debilitating joint damage and deformation, resulting in progressive functional limitation. Consequently, RA is considered a highly disabling disease with a considerable economic impact that some liken to that of coronary artery disease (Allaire et al., 1994, *Pharmacoeconomics* 6:513-522). A 1993 study in the U.S. estimated total annual direct costs of $5275 per patient with indirect costs as high as $21,000 per year (Merkesdal et al., 2001, *Arthritis Rheum.* 44:528-534).

RA is thought to be precipitated by the interplay of environmental and genetic factors. Although several environmental triggers have been suggested, such as infection (Harris, 1990, *N. Engl. J. Med.* 322:1277-1289), immunization (Symmons and Chakravarty, 1993, *Ann. Rheum. Dis.* 52:843-844), diet (Shapiro et al., 1996, *Epidemiology* 7:256-263), and smoking (Symmons et al., 1997, *Arthritis Rheum.* 40:1955-1961), none have been established. A genetic component to RA susceptibility has long been indicated by data from twin and family studies. It is estimated that the concordance between monozygotic twins is in the range of 12-15% while the prevalence in siblings of RA probands is approximately 2-4%, both well above the estimated background population prevalence of 0.5-1% (Seldin et al., 1999, *Arthritis Rheum.* 42:1071-1079). From these data, the disease heritability has been estimated at approximately 60% (MacGregor et al., 2000, *Arthritis Rheum.* 43:30-37) while the relative recurrence risk for siblings ($\lambda$s) of probands with RA is estimated at between 5 and 10 (Seldin et al. 1999; Jawaheer et al., 2001, *Am. J. Hum. Genet.* 68:927-936).

The increasing availability of specific therapies that can halt disease progression has magnified the need for accurate early diagnosis of RA (Maini et al., 1999, *Lancet* 354:1932-1939; Lipsky et al., 2000, *N. Engl. J. Med.* 343: 1594-1602; Weinblatt et al., 1999, *N. Engl. J. Med.* 340: 253-259). The most commonly used diagnostic criteria are those adopted by the American College of Rheumatology in 1987 (Arnett et al., 1988, *Arthritis Rheum.* 31: 315-324), which are based on a combination of clinical, laboratory and radiological assessments. A patient is classified as having RA if he or she satisfies at least four of the following seven criteria: (i) morning stiffness lasting at least one hour; (ii) arthritis of three or more joint areas; (iii) arthritis of hand joints; (iv) symmetric arthritis; (v) rheumatoid nodules; (vi) presence of serum rheumatoid factor (RF); and (vii) radiographic changes in hand or wrist joints. Using these criteria, a trained rheumatologist can usually diagnose RA in individuals who have had disease for more than 12 weeks (Harrison et al., 1998, *J. Rheumatol.* 25: 2324-2330). However, these criteria are largely ineffective for patients during early stages of the disease, such as during the first 12 weeks of disease (Green et al., 1999, *Arthritis Rheum.* 42: 2184-2188), during which time irreversible joint damage has already begun, and cannot predict which patients will develop severe erosive disease and therefore benefit from aggressive early disease modifying therapy.

Early initiation of therapy can provide considerable benefit, not only by reducing pain and inflammation but also by reducing or eliminating the loss of function that accompanies persistent RA, especially when therapy is administered prior to the occurrence of irreversible joint damage. Consequently, there is a need for novel diagnostic markers that, for example, enable the detection of RA, particularly at an early stage, or that enable the identification of individuals who are predisposed to developing RA.

Single Nucleotide Polymorphisms (SNPs)

The genomes of all organisms undergo spontaneous mutation in the course of their continuing evolution, generating variant forms of progenitor genetic sequences. Gusella, *Ann Rev Biochem* 55:831-854 (1986). A variant form may confer an evolutionary advantage or disadvantage relative to a progenitor form or may be neutral. In some instances, a variant form confers an evolutionary advantage to individual members of a species and is eventually incorporated into the DNA of many or most members of the species and effectively becomes the progenitor form. Additionally, the effects of a variant form may be both beneficial and detrimental, depending on the environment. For example, a heterozygous sickle cell mutation confers resistance to malaria, but a homozygous sickle cell mutation is usually lethal. In many cases, both progenitor and variant forms survive and co-exist in a species population. The coexistence of multiple forms of a genetic sequence segregating at appreciable frequencies is defined as a genetic polymorphism, which includes single nucleotide polymorphisms (SNPs).

Approximately 90% of all genetic polymorphisms in the human genome are SNPs. SNPs are single base positions in DNA at which different alleles, or alternative nucleotides, exist in a population. The SNP position (interchangeably referred to herein as SNP, SNP site, SNP locus, SNP marker, or marker) is usually preceded by and followed by highly conserved sequences of the allele (e.g., sequences that vary in less than $\frac{1}{100}$ or $\frac{1}{1000}$ members of the populations). An individual may be homozygous or heterozygous for an allele at each SNP position. A SNP can, in some instances, be referred to as a "cSNP" to denote that the nucleotide sequence containing the SNP is an amino acid coding sequence.

A SNP may arise from a substitution of one nucleotide for another at the polymorphic site. Substitutions can be transitions or transversions. A transition is the replacement of one purine nucleotide by another purine nucleotide, or one pyrimidine by another pyrimidine. A transversion is the replacement of a purine by a pyrimidine, or vice versa. A SNP may also be a single base insertion or deletion variant referred to as an "indel." Weber et al., "Human diallelic insertion/deletion polymorphisms," *Am J Hum Genet.* 71(4):854-62 (October 2002).

A synonymous codon change, or silent mutation/SNP (terms such as "SNP," "polymorphism," "mutation," "mutant," "variation," and "variant" are used herein interchangeably), is one that does not result in a change of amino acid due to the degeneracy of the genetic code. A substitution that changes a codon coding for one amino acid to a codon coding for a different amino acid (i.e., a non-synonymous codon change) is referred to as a missense mutation. A nonsense mutation results in a type of non-synonymous codon change in which a stop codon is formed, thereby leading to premature termination of a polypeptide chain and a truncated protein. A read-through mutation is another type of non-synonymous codon change that causes the destruction of a stop codon, thereby resulting in an extended polypeptide product. While SNPs can be bi-, tri-, or tetra-allelic, the vast majority of SNPs are bi-allelic, and are thus often referred to as "bi-allelic markers," or "di-allelic markers."

As used herein, references to SNPs and SNP genotypes include individual SNPs and/or haplotypes, which are groups of SNPs that are generally inherited together. Haplotypes can have stronger correlations with diseases or other phenotypic effects compared with individual SNPs, and therefore may provide increased diagnostic accuracy in some cases. Stephens et al., *Science* 293:489-493 (July 2001).

Causative SNPs are those SNPs that produce alterations in gene expression or in the expression, structure, and/or function of a gene product, and therefore are most predictive of a possible clinical phenotype. One such class includes SNPs falling within regions of genes encoding a polypeptide product, i.e. cSNPs. These SNPs may result in an alteration of the amino acid sequence of the polypeptide product (i.e., non-synonymous codon changes) and give rise to the expression of a defective or other variant protein. Furthermore, in the case of nonsense mutations, a SNP may lead to premature termination of a polypeptide product. Such variant products can result in a pathological condition, e.g., genetic disease. Examples of genes in which a SNP within a coding sequence causes a genetic disease include sickle cell anemia and cystic fibrosis.

Causative SNPs do not necessarily have to occur in coding regions; causative SNPs can occur in, for example, any genetic region that can ultimately affect the expression, structure, and/or activity of the protein encoded by a nucleic acid. Such genetic regions include, for example, those involved in transcription, such as SNPs in transcription factor binding domains, SNPs in promoter regions, in areas involved in transcript processing, such as SNPs at intron-exon boundaries that may cause defective splicing, or SNPs in mRNA processing signal sequences such as polyadenylation signal regions. Some SNPs that are not causative SNPs nevertheless are in close association with, and therefore segregate with, a disease-causing sequence. In this situation, the presence of a SNP correlates with the presence of, or predisposition to, or an increased risk in developing the disease. These SNPs, although not causative, are nonetheless also useful for diagnostics, disease predisposition screening, and other uses.

An association study of a SNP and a specific disorder involves determining the presence or frequency of the SNP allele in biological samples from individuals with the disorder of interest, such as autoimmune disease, and comparing the information to that of controls (i.e., individuals who do not have the disorder; controls may be also referred to as "healthy" or "normal" individuals) who are preferably of similar age and race. The appropriate selection of patients and controls is important to the success of SNP association studies. Therefore, a pool of individuals with well-characterized phenotypes is extremely desirable.

A SNP may be screened in diseased tissue samples or any biological sample obtained from a diseased individual, and compared to control samples, and selected for its increased (or decreased) occurrence in a specific pathological condition, such as pathologies related to autoimmune disease and in particular, RA. Once a statistically significant association is established between one or more SNP(s) and a pathological condition (or other phenotype) of interest, then the region around the SNP can optionally be thoroughly screened to identify the causative genetic locus/sequence(s) (e.g., causative SNP/mutation, gene, regulatory region, etc.) that influences the pathological condition or phenotype. Association studies may be conducted within the general population and are not limited to studies performed on related individuals in affected families (linkage studies).

Clinical trials have shown that patient response to treatment with pharmaceuticals is often heterogeneous. There is a continuing need to improve pharmaceutical agent design and therapy. In that regard, SNPs can be used to identify patients most suited to therapy with particular pharmaceutical agents (this is often termed "pharmacogenomics"). Similarly, SNPs can be used to exclude patients from certain treatment due to the patient's increased likelihood of developing toxic side effects or their likelihood of not responding to the treatment. Pharmacogenomics can also be used in pharmaceutical research to assist the drug development and selection process. Linder et al., *Clinical Chemistry* 43:254 (1997); Marshall, *Nature Biotechnology* 15:1249 (1997); International Patent Application WO 97/40462, Spectra Biomedical; and Schafer et al., *Nature Biotechnology* 16:3 (1998).

SUMMARY OF THE INVENTION

The present invention relates to the identification of SNPs, as well as unique combinations of such SNPs and haplotypes of SNPs, that are associated with autoimmune disease, particularly rheumatoid arthritis (RA). The polymorphisms disclosed herein are directly useful as targets for the design of diagnostic and prognostic reagents and the development of therapeutic and preventive agents for use in the diagnosis, prognosis, treatment, and/or prevention of autoimmune disease (particularly RA), as well as for predicting a patient's response to therapeutic agents such as tumor necrosis factor (TNF) inhibitors, particularly for the treatment or prevention of autoimmune disease.

Based on the identification of SNPs associated with autoimmune disease (particularly RA), the present invention also provides methods of detecting these variants as well as the design and preparation of detection reagents needed to accomplish this task. The invention specifically provides, for example, SNPs associated with autoimmune disease (particularly RA), isolated nucleic acid molecules (including DNA and RNA molecules) containing these SNPs, variant proteins encoded by nucleic acid molecules containing such SNPs, antibodies to the encoded variant proteins, computer-based and data storage systems containing the novel SNP information, methods of detecting these SNPs in a test sample, methods of identifying individuals who have an altered (i.e., increased or decreased) risk of developing autoimmune disease (particularly RA), methods for determining the risk of an individual for recurring autoimmune disease (e.g., recurrent RA), methods for prognosing the severity or consequences of autoimmune disease, methods of treating an individual who has an increased risk for autoimmune disease, and methods for identifying individuals (e.g., determining a particular individual's likelihood) who have an altered (i.e., increased or decreased) likelihood of responding to drug treatment, particularly drug treatment of autoimmune disease (e.g., treatment or prevention of RA), based on the presence or absence of one or more particular nucleotides (alleles) at one or more SNP sites disclosed herein or the detection of one or more encoded variant products (e.g., variant mRNA transcripts or variant proteins), methods of identifying individuals who are more or less likely to respond to a treatment (or more or less likely to experience undesirable side effects from a treatment), methods of screening for compounds useful in the treatment or prevention of a disorder associated with a variant gene/protein, compounds identified by these methods, methods of treating or preventing disorders mediated by a variant gene/protein, methods of using the novel SNPs of the present invention for human identification, etc.

The present invention further provides methods for selecting or formulating a treatment regimen (e.g., methods for determining whether or not to administer TNF inhibitor treatment to an individual having autoimmune disease, or who is at risk for developing autoimmune disease in the future, or who has previously had autoimmune disease, methods for selecting a particular TNF inhibitor-based treatment regimen such as dosage and frequency of administration of TNF inhibitor, or a particular form/type of TNF inhibitor such as a particular antibody, fusion protein, small molecule compound, nucleic acid agent, pharmaceutical formulation, etc., methods for administering an alternative, non-TNF inhibitor treatment to individuals who are predicted to be unlikely to respond positively to TNF inhibitor treatment, etc.), and methods for determining the likelihood of experiencing toxicity or other undesirable side effects from TNF inhibitor treatment, etc. The present invention also provides methods for selecting individuals to whom a TNF inhibitor or other therapeutic will be administered based on the individual's genotype, and methods for selecting individuals for a clinical trial of a TNF inhibitor or other therapeutic agent based on the genotypes of the individuals (e.g., selecting individuals to participate in the trial who are most likely to respond positively from the TNF inhibitor treatment and/or excluding individuals from the trial who are unlikely to respond positively from the TNF inhibitor treatment based on their SNP genotype(s), or selecting individuals who are unlikely to respond positively to TNF inhibitors based on their SNP genotype(s) to participate in a clinical trial of another type of drug that may benefit them). The present invention further provides methods for reducing an individual's risk of developing autoimmune disease (such as RA) using TNF inhibitor treatment, including preventing recurring autoimmune disease (e.g., recurrent RA) using TNF inhibitor treatment, when said individual carries one or more SNPs identified herein as being associated with autoimmune disease.

In Tables 1 and 2, the present invention provides gene information, references to the identification of transcript sequences (SEQ ID NOS:1-16), encoded amino acid sequences (SEQ ID NOS:17-32), genomic sequences (SEQ ID NOS:78-91), transcript-based context sequences (SEQ ID NOS:33-77) and genomic-based context sequences (SEQ ID NOS:92-584) that contain the SNPs of the present invention, and extensive SNP information that includes observed alleles, allele frequencies, populations/ethnic groups in which alleles have been observed, information about the type of SNP and corresponding functional effect, and, for cSNPs, information about the encoded polypeptide product. The actual transcript sequences (SEQ ID NOS:1-16), amino acid sequences (SEQ ID NOS:17-32), genomic sequences (SEQ ID NOS:78-91), transcript-based SNP context sequences (SEQ ID NOS:33-77), and genomic-based SNP context sequences (SEQ ID NOS:92-584), together with primer sequences (SEQ ID NOS:585-1004) are provided in the Sequence Listing.

In certain exemplary embodiments, the invention provides methods for identifying an individual who has an altered risk for developing autoimmune disease such as RA (including, for example, a first incidence and/or a recurrence of the disease), in which the method comprises detecting a single nucleotide polymorphism (SNP) in any one of the nucleotide sequences of SEQ ID NOS:1-16, SEQ ID NOS:33-77, SEQ ID NOS:78-91, and SEQ ID NOS:92-584 in said individual's nucleic acids, wherein the SNP is specified in Table 1 and/or Table 2, and the presence of the SNP is indicative of an altered risk for autoimmune disease in said individual. In certain embodiments, the autoimmune disease is RA. In certain exemplary embodiments of the invention, SNPs that occur naturally in the human genome are provided as isolated nucleic acid molecules. These SNPs are associated with autoimmune disease, particular RA, such that they can have a variety of uses in the diagnosis, prognosis, treatment, and/or prevention of autoimmune disease and related pathologies, and in the treatment or prevention of autoimmune disease, particularly by using TNF inhibitors. In an alternative embodiment, a nucleic acid of the invention is an amplified polynucleotide, which is produced by amplification of a SNP-containing nucleic acid template. In another embodiment, the invention provides for a variant protein that is encoded by a nucleic acid molecule containing a SNP disclosed herein.

In yet another embodiment of the invention, a reagent for detecting a SNP in the context of its naturally-occurring flanking nucleotide sequences (which can be, e.g., either DNA or mRNA) is provided. In particular, such a reagent may be in the form of, for example, a hybridization probe or an amplification primer that is useful in the specific detection of a SNP of interest. In an alternative embodiment, a protein detection reagent is used to detect a variant protein that is encoded by a nucleic acid molecule containing a SNP disclosed herein. A preferred embodiment of a protein detection reagent is an antibody or an antigen-reactive antibody fragment. Various embodiments of the invention also provide kits comprising SNP detection reagents, and methods for detecting the SNPs disclosed herein by employing detection reagents.

In various embodiments, the present invention provides for a method of identifying an individual having an increased or decreased risk of developing autoimmune disease (e.g., RA) by detecting the presence or absence of one or more SNP alleles (or haplotypes or diplotypes) disclosed herein. In other embodiments, a method for diagnosis or prognosis of autoimmune disease (e.g., RA) by detecting the presence or absence of one or more SNP alleles (or haplotypes or diplotypes) disclosed herein is provided. The present invention also provides methods for evaluating whether an individual is likely (or unlikely) to respond to TNF inhibitor treatment, particularly TNF inhibitor treatment of autoimmune disease, by detecting the presence or absence of one or more SNP alleles (or haplotypes or diplotypes) disclosed herein.

In certain exemplary embodiments, the invention provides methods and compositions based on any of the following SNPs, individually or in any combination: rs1953126, rs10985196, rs6478486, rs4836834, rs2239657, rs7021880, rs7021049, rs10760117, rs7046030, rs12683459, rs1323472, rs942152, rs2900180, rs7026635, rs10818527, rs1609810, rs881375, and the other SNPs disclosed herein (such as the SNPs provided in any of Tables 1-7 and 9-16), as well as combinations thereof. For example, in certain exemplary embodiments, the invention provides methods for determining an individual's risk for developing autoimmune disease (particularly RA), methods for diagnosing or prognosing autoimmune disease (particularly RA), methods for predicting an individual's response to a TNF inhibitor or other drug, as well as other methods of use, by detecting which allele (e.g., nucleotide) is present at any or all of these SNPs, as well as reagents and other compositions for carrying out these methods.

In certain exemplary embodiments, the invention provides methods and compositions based on combinations consisting of, consisting essentially of, or comprising the SNPs rs2239657, rs7021880, and rs7021049, and subcombinations thereof. For example, in certain exemplary embodiments, the invention provides methods for determining an individual's risk for developing autoimmune disease, particularly RA, by detecting which allele (e.g., nucleotide) is present at any or all of SNPs rs2239657, rs7021880, and rs7021049, as well as reagents and other compositions for carrying out these methods. Similarly, the invention also provides methods such as diagnosing or prognosing autoimmune disease, particularly RA, as well as methods for predicting an individual's response to a drug, particularly a TNF inhibitor, by detecting which allele (e.g., nucleotide) is present at any or all of SNPs rs2239657, rs7021880, and rs7021049, as well as reagents and other compositions for carrying out these and other methods.

In certain further embodiments, the invention provides haplotypes consisting of, consisting essentially of, or comprising the following combinations of alleles at SNPs rs2239657, rs7021880, and rs7021049: rs2239657(A)-rs7021880(G)-rs7021049(T) as a protective haplotype, rs2239657(G)-rs7021880(C)-rs7021049(G) as a risk (predisposition) haplotype, as well as rs2239657(A)-rs7021880(G)-rs7021049(G) and rs2239657(G)-rs7021880(G)-rs7021049 (G) (see, e.g., Table 10). In certain further embodiments, the invention provides diplotypes consisting of, consisting essentially of, or comprising the following combinations of alleles at SNPs rs2239657, rs7021880, and rs7021049: rs2239657(A)-rs7021880(G)-rs7021049(T)/rs2239657(A)-rs7021880(G)-rs7021049(T) as a protective diplotype, rs2239657(G)-rs7021880(C)-rs7021049(G)/rs2239657(G)-rs7021880(C)-rs7021049(G) as a risk (predisposition) diplotype, as well as rs2239657(A)-rs7021880(G)-rs7021049(T)/rs2239657(G)-rs7021880(C)-rs7021049(G), particularly as a risk (predisposition) diplotype (see, e.g., Table 11).

Examples of other combinations of SNPs (such as haplotypes or diplotypes) of the invention include those consisting of, consisting essentially of, or comprising the following combinations of SNPs, as well as subcombinations of any of these SNPs: rs6478486-rs4836834-rs2239657-rs7021880-rs7021049 and rs2239657-rs7021880-rs7021049-rs2900180-rs2269066, as well as other haplotypes and diplotypes between and/or including rs10985070 and rs2900180.

In certain exemplary embodiments, the invention provides methods and compositions based on the any of the SNPs disclosed herein, particularly the TRAF1 SNPs disclosed herein (and combinations thereof such as haplotypes and diplotypes), and especially SNPs rs2239657, rs7021880, and rs7021049 (as well as subcombination thereof), in combination with PTPN22 and/or HLA-DRB1 polymorphisms, such as shown in FIG. 1 and Table 15. For example, the TRAF1 risk diplotype rs2239657(G)-rs7021880(C)-rs7021049(G)/ rs2239657(G)-rs7021880(C)-rs7021049(G) and/or the TRAF1 protective diplotype rs2239657(A)-rs7021880(G)-rs7021049(T)/rs2239657(A)-rs7021880(G)-rs7021049(T) can be detected in combination with PTPN22 and/or HLA-DRB1 polymorphisms, particularly the R620 W PTPN22 polymorphism (e.g., in which a CC genotype indicates homozygosity for the protective R620 allele, and TT and TC genotypes indicate carriage of the risk W620 allele) and/or the number of copies of the HLA-DRB1 shared epitope (e.g., 0SE, 1SE, or 2SE), such as to determine an individual's risk for developing autoimmune disease, particularly RA. For example, individuals with the protective genotype at all three loci (0SE for HLA-DRB1, CC genotype (R620 allele) for PTPN22 and the rs2239657(A)-rs7021880(G)-rs7021049(T)/rs2239657(A)-rs7021880(G)-rs7021049(T) TRAF1 diplotype) have a substantially reduced predicted risk of RA compared with individuals with the risk genotype at all three loci (2SE for HLA-DRB1, TT or TC genotype (W620 allele) at PTPN22, and the rs2239657(G)-rs7021880(C)-rs7021049(G)/rs2239657(G)-rs7021880(C)-rs7021049(G) TRAF1 diplotype). Between these lowest and highest risk categories, risk for RA increases or decreases commensurately according to an invidual's particular combination of risk or protective genotypes at each of the TRAF1 locus (e.g., in which the rs2239657(A)-rs7021880(G)-rs7021049(T)/rs2239657(A)-rs7021880(G)-rs7021049(T) diplotype indicates lower risk and the rs2239657(G)-rs7021880(C)-rs7021049(G)/rs2239657(G)-rs7021880(C)-rs7021049(G) diplotype indicates higher risk), the PTPN22 locus (e.g., in which a CC genotype/R620 allele indicates lower risk for RA, and at least one T nucleotide (TT or TC genotype)/W620 allele indicates higher risk for RA), and/or the HLA-DRB1 locus (e.g., in which 0SE indicates lowest risk, 1 SE indicates intermediate risk, and 2SE indicates highest risk) (see FIG. 1 and Table 15 as an example).

The nucleic acid molecules of the invention can be inserted in an expression vector, such as to produce a variant protein in a host cell. Thus, the present invention also provides for a vector comprising a SNP-containing nucleic acid molecule, genetically-engineered host cells containing the vector, and methods for expressing a recombinant variant protein using such host cells. In another specific embodiment, the host cells, SNP-containing nucleic acid molecules, and/or variant proteins can be used as targets in a method for screening and identifying therapeutic agents or pharmaceutical compounds useful in the treatment or prevention of autoimmune disease (particularly RA).

An aspect of this invention is a method for treating or preventing autoimmune disease such as RA (including, for example, a first occurrence and/or a recurrence of the disease), in a human subject wherein said human subject harbors a SNP, gene, transcript, and/or encoded protein identified in Tables 1 and 2, which method comprises administering to said human subject a therapeutically or prophylactically effective amount of one or more agents counteracting the effects of the disease, such as by inhibiting (or stimulating) the activity of a gene, transcript, and/or encoded protein identified in Tables 1 and 2.

Another aspect of this invention is a method for identifying an agent useful in therapeutically or prophylactically treating autoimmune disease (particularly RA), in a human subject wherein said human subject harbors a SNP, gene, transcript, and/or encoded protein identified in Tables 1 and 2, which method comprises contacting the gene, transcript, or encoded protein with a candidate agent under conditions suitable to allow formation of a binding complex between the gene, transcript, or encoded protein and the candidate agent and detecting the formation of the binding complex, wherein the presence of the complex identifies said agent.

Another aspect of this invention is a method for treating or preventing autoimmune disease (such as RA), in a human subject, in which the method comprises:

(i) determining that said human subject harbors a SNP, gene, transcript, and/or encoded protein identified in Tables 1 and 2, and (ii) administering to said subject a therapeutically or prophylactically effective amount of one or more agents counteracting the effects of the disease, such as TNF inhibitors.

Another aspect of the invention is a method for identifying a human who is likely to benefit from TNF inhibitor treatment, in which the method comprises detecting an allele of one or more SNPs disclosed herein in said human's nucleic acids, wherein the presence of the allele indicates that said human is likely to benefit from TNF inhibitor treatment.

Another aspect of the invention is a method for identifying a human who is likely to benefit from TNF inhibitor treatment, in which the method comprises detecting an allele of one or more SNPs that are in LD with one or more SNPs disclosed herein in said human's nucleic acids, wherein the presence of the allele of the LD SNP indicates that said human is likely to benefit from TNF inhibitor treatment.

Many other uses and advantages of the present invention will be apparent to those skilled in the art upon review of the detailed description of the preferred embodiments herein. Solely for clarity of discussion, the invention is described in the sections below by way of non-limiting examples.

Description of the Files Contained on The CD-Rs

Each of the three CD-Rs contains an identical copy of each the following three text files:

1) File CD000019ORD_SEQLIST.txt provides the Sequence Listing. The Sequence Listing provides the transcript sequences (SEQ ID NOS:1-16) and protein sequences (SEQ ID NOS:17-32) as referred to in Table 1, and genomic sequences (SEQ ID NOS:78-91) as referred to in Table 2, for each autoimmune disease-associated gene (or genomic region for intergenic SNPs) that contains one or more SNPs of the present invention. Also provided in the Sequence Listing are context sequences flanking each SNP, including both transcript-based context sequences as referred to in Table 1 (SEQ ID NOS:33-77) and genomic-based context sequences as referred to in Table 2 (SEQ ID NOS:92-584). In addition, the Sequence Listing provides the primer sequences from Table 3 (SEQ ID NOS:585-1004), which are oligonucleotides that have been synthesized and used in the laboratory to assay certain SNPs disclosed herein by allele-specific PCR during the course of association studies to verify the association of these SNPs with autoimmune disease. The context sequences generally provide 100 bp upstream (5') and 100 bp downstream (3') of each SNP, with the SNP in the middle of the context sequence, for a total of 200 bp of context sequence surrounding each SNP.

File CD000019ORD_SEQLIST.txt is 1,595 KB in size, and was created on Aug. 29, 2008. In accordance with 37 C.F.R. §1.821 (f), the information recorded on each of the CDRs submitted herewith is identical.

2) File CD000019ORD_TABLE1.txt provides Table 1. File CD0000190ORD_TABLE1.txt is 51 KB in size, and was created on Aug. 28, 2008.

3) File CD000019ORD_TABLE2.txt provides Table 2. File CD000019ORD_TABLE2.txt is 390 KB in size, and was created on Aug. 29, 2008.

The material contained on the CD-R is hereby incorporated by reference pursuant to 37 CFR 1.77(b)(4).

Description of Table 1 and Table 2

Table 1 and Table 2 (both provided on the CD-R) disclose the SNP and associated gene/transcript/protein information of the present invention. For each gene, Table 1 provides a header containing gene, transcript and protein information, followed by a transcript and protein sequence identifier (SEQ ID NO), and then SNP information regarding each SNP found in that gene/transcript including the transcript context sequence. For each gene in Table 2, a header is provided that contains gene and genomic information, followed by a genomic sequence identifier (SEQ ID NO) and then SNP information regarding each SNP found in that gene, including the genomic context sequence.

Note that SNP markers may be included in both Table 1 and Table 2; Table 1 presents the SNPs relative to their transcript sequences and encoded protein sequences, whereas Table 2 presents the SNPs relative to their genomic sequences. In some instances Table 2 may also include, after the last gene sequence, genomic sequences of one or more intergenic regions, as well as SNP context sequences and other SNP information for any SNPs that lie within these intergenic regions. Additionally, in either Table 1 or 2 a "Related Interrogated SNP" may be listed following a SNP which is determined to be in LD with that interrogated SNP according to the given Power value. SNPs can be readily cross-referenced between all Tables based on their Celera hCV (or, in some instances, hDV) identification numbers and/or public rs identification numbers, and to the Sequence Listing based on their corresponding SEQ ID NOs.

The gene/transcript/protein information includes:
  a gene number (1 through n, where n=the total number of genes in the Table),
  a gene symbol, along with an Entrez gene identification number (Entrez Gene database, National Center for Biotechnology Information (NCBI), National Library of Medicine, National Institutes of Health)
  a gene name,
  an accession number for the transcript (e.g., RefSeq NM number, or a Celera hCT identification number if no RefSeq NM number is available) (Table 1 only),
  an accession number for the protein (e.g., RefSeq NP number, or a Celera hCP identification number if no RefSeq NP number is available) (Table 1 only),
  the chromosome number of the chromosome on which the gene is located,
  an OMIM ("Online Mendelian Inheritance in Man" database, Johns Hopkins University/NCBI) public reference number for the gene, and OMIM information such as alternative gene/protein name(s) and/or symbol(s) in the OMIM entry.

Note that, due to the presence of alternative splice forms, multiple transcript/protein entries may be provided for a single gene entry in Table 1; i.e., for a single Gene Number, multiple entries may be provided in series that differ in their transcript/protein information and sequences.

Following the gene/transcript/protein information is a transcript context sequence (Table 1), or a genomic context sequence (Table 2), for each SNP within that gene.

After the last gene sequence, Table 2 may include additional genomic sequences of intergenic regions (in such instances, these sequences are identified as "Intergenic region:" followed by a numerical identification number), as well as SNP context sequences and other SNP information for any SNPs that lie within each intergenic region (such SNPs are identified as "INTERGENIC" for SNP type).

Note that the transcript, protein, and transcript-based SNP context sequences are all provided in the Sequence Listing. The transcript-based SNP context sequences are provided in both Table 1 and also in the Sequence Listing. The genomic and genomic-based SNP context sequences are provided in the Sequence Listing. The genomic-based SNP context sequences are provided in both Table 2 and in the Sequence Listing. SEQ ID NOs are indicated in Table 1 for the transcript-based context sequences (SEQ ID NOS:33-77); SEQ ID NOs are indicated in Table 2 for the genomic-based context sequences (SEQ ID NOS:92-584).

The SNP information includes:
  Context sequence (taken from the transcript sequence in Table 1, the genomic sequence in Table 2) with the SNP represented by its IUB code, including 100 bp upstream (5') of the SNP position plus 100 bp downstream (3') of the SNP position (the transcript-based SNP context sequences in Table 1 are provided in the Sequence Listing as SEQ ID NOS:33-77; the genomic-based SNP context sequences in Table 2 are provided in the Sequence Listing as SEQ ID NOS:92-584).
  Celera hCV internal identification number for the SNP (in some instances, an "hDV" number is given instead of an "hCV" number).
  The corresponding public identification number for the SNP, the rs number.
  "SNP Chromosome Position" indicates the nucleotide position of the SNP along the entire sequence of the chromosome as provided in NCBI Genome Build 36.
  SNP position (nucleotide position of the SNP within the given transcript sequence (Table 1) or within the given genomic sequence (Table 2)).
  "Related Interrogated SNP" is the interrogated SNP with which the listed SNP is in LD at the given value of Power.
  SNP source (may include any combination of one or more of the following five codes, depending on which internal sequencing projects and/or public databases the SNP has been observed in: "Applera"=SNP observed during the re-sequencing of genes and regulatory regions of 39 individuals, "Celera"=SNP observed during shotgun sequencing and assembly of the Celera human genome sequence, "Celera Diagnostics"=SNP observed during re-sequencing of nucleic acid samples from individuals who have a disease, "dbSNP"=SNP observed in the dbSNP public database, "HGBASE"=SNP observed in the HGBASE public database, "HGMD"=SNP observed in the Human Gene Mutation Database (HGMD) public database, "HapMap"=SNP observed in the International HapMap Project public database, "CSNP"=SNP observed in an internal Applied Biosystems (Foster City, Calif.) database of coding SNPS (cSNPs).
  Note that multiple "Applera" source entries for a single SNP indicate that the same SNP was covered by multiple overlapping amplification products and the re-sequencing results (e.g., observed allele counts) from each of these amplification products is being provided.
  Population/allele/allele count information in the format of [population1(first_allele,count|second_allele,count) population2(first_allele,count|second_allele,count) total (first_allele,total count|second_allele,total count)]. The information in this field includes populations/ethnic groups in which particular SNP alleles have been observed ("cau"=Caucasian, "his"=Hispanic, "chn"=Chinese, and "afr"=African-American, "jpn"=Japanese, "ind"=Indian, "mex"=Mexican, "ain"="American Indian, "cra"=Celera donor, "no_pop"=no population information available), identified SNP alleles, and observed allele counts (within each population group and total allele counts), where available ["−" in the allele field represents a deletion allele of an insertion/deletion ("indel") polymorphism (in which case the corresponding insertion allele, which may be comprised of one or more nucleotides, is indicated in the allele field on the opposite side of the "|"); "−" in the count field indicates that allele count information is not available]. For certain SNPs from the public dbSNP database, population/ethnic information is indicated as follows (this population information is publicly available in dbSNP): "HISP1"=human individual DNA (anonymized samples) from 23 individuals of self-described HISPANIC heritage; "PAC1"=human individual DNA (anonymized samples) from 24 individuals of self-described PACIFIC RIM heritage; "CAUC1"=human individual DNA (anonymized samples) from 31 individuals of self-described CAUCASIAN heritage; "AFR1"=human individual DNA (anonymized samples) from 24 individuals of self-described AFRICAN/AFRICAN AMERICAN heritage; "P1"=human individual DNA (anonymized samples) from 102 individuals of self-described heritage; "PA130299515"; "SC_12_A"=SANGER 12 DNAs of Asian origin from Corielle cell repositories, 6 of which are male and 6 female; "SC_12_C"=SANGER 12 DNAs of Caucasian origin from Corielle cell repositories from the CEPH/UTAH library, six male and six female; "SC_12_AA"=SANGER 12 DNAs of African-American origin from Corielle cell repositories 6 of which are male and 6 female; "SC_95_C"=SANGER 95 DNAs of Caucasian origin from Corielle cell repositories from the CEPH/UTAH library; and "SC_12_CA"=Caucasians −12 DNAs from Corielle cell repositories that are from the CEPH/UTAH library, six male and six female.

Note that for SNPs of "Applera" SNP source, genes/regulatory regions of 39 individuals (20 Caucasians and 19 African Americans) were re-sequenced and, since each SNP position is represented by two chromosomes in each individual (with the exception of SNPs on X and Y chromosomes in males, for which each SNP position is represented by a single chromosome), up to 78 chromosomes were genotyped for each SNP position. Thus, the sum of the African-American ("afr") allele counts is up to 38, the sum of the Caucasian allele counts ("cau") is up to 40, and the total sum of all allele counts is up to 78.

Note that semicolons separate population/allele/count information corresponding to each indicated SNP source; i.e., if four SNP sources are indicated, such as "Celera," "dbSNP," "HGBASE," and "HGMD," then population/allele/count information is provided in four groups which are separated by semicolons and listed in the same order as the listing of SNP sources, with each population/allele/count information group corresponding to the respective SNP source based on order; thus, in this example, the first population/allele/count information group would correspond to the first listed SNP source (Celera) and the third population/allele/count information group separated by semicolons would correspond to the third listed SNP source (HGBASE); if population/allele/count information is not available for any particular SNP source, then a pair of semicolons is still inserted as a place-holder in order to maintain correspondence between the list of SNP sources and the corresponding listing of population/allele/count information.

SNP type (e.g., location within gene/transcript and/or predicted functional effect) ["MIS-SENSE MUTATION"=SNP causes a change in the encoded amino acid (i.e., a non-synonymous coding SNP); "SILENT MUTATION"=SNP does not cause a change in the encoded amino acid (i.e., a synonymous coding SNP); "STOP CODON MUTATION"=SNP is located in a stop codon; "NONSENSE MUTATION"=SNP creates or destroys a stop codon; "UTR 5"=SNP is located in a 5' UTR of a transcript; "UTR 3"=SNP is located in a 3' UTR of a transcript; "PUTATIVE UTR 5"=SNP is located in a putative 5' UTR; "PUTATIVE UTR 3"=SNP is located in a putative 3' UTR; "DONOR SPLICE SITE"=SNP is located in a donor splice site (5' intron boundary); "ACCEPTOR SPLICE SITE"=SNP is located in an acceptor splice site (3' intron boundary); "CODING REGION"=SNP is located in a protein-coding region of the transcript; "EXON"=SNP is located in an exon; "INTRON"=SNP is located in an intron; "hmCS"=SNP is located in a human-mouse conserved segment; "TFBS"=SNP is located in a transcription factor binding site; "UNKNOWN"=SNP type is not defined; "INTERGENIC"=SNP is intergenic, i.e., outside of any gene boundary].

Protein coding information (Table 1 only), where relevant, in the format of [protein SEQ ID NO, amino acid position, (amino acid-1, codon1) (amino acid-2, codon2)]. The information in this field includes SEQ ID NO of the encoded protein sequence, position of the amino acid residue within the protein identified by the SEQ ID NO that is encoded by the codon containing the SNP, amino acids (represented by one-letter amino acid codes) that are encoded by the alternative SNP alleles (in the case of stop codons, "X" is used for the one-letter amino acid code), and alternative codons containing the alternative SNP nucleotides which encode the amino acid residues (thus, for example, for missense mutation-type SNPs, at least two different amino acids and at least two different codons are generally indicated; for silent mutation-type SNPs, one amino acid and at least two different codons are generally indicated, etc.). In instances where the SNP is located outside of a protein-coding region (e.g., in a UTR region), "None" is indicated following the protein SEQ ID NO.

Description of Table 3

Table 3 provides sequences (SEQ ID NOS:585-1004) of primers that may be used to assay the SNPs disclosed herein by allele-specific PCR or other methods, such as for uses related to autoimmune disease, particularly RA (see Examples section).

Table 3 provides the following:

the column labeled "Marker" provides an hCV identification number for each SNP that can be detected using the corresponding primers.

the column labeled "Alleles" designates the two alternative alleles (i.e., nucleotides) at the SNP site. These alleles are targeted by the allele-specific primers (the allele-specific primers are shown as Primer 1 and Primer 2). Note that alleles may be presented in Table 3 based on a different orientation (i.e., the reverse complement) relative to how the same alleles are presented in Tables 1-2.

the column labeled "Primer 1 (Allele-Specific Primer)" provides an allele-specific primer that is specific for an allele designated in the "Alleles" column.

the column labeled "Primer 2 (Allele-Specific Primer)" provides an allele-specific primer that is specific for the other allele designated in the "Alleles" column.

the column labeled "Common Primer" provides a common primer that is used in conjunction with each of the allele-specific primers (i.e., Primer 1 and Primer 2) and which hybridizes at a site away from the SNP position.

All primer sequences are given in the 5' to 3' direction.

Each of the nucleotides designated in the "Alleles" column matches or is the reverse complement of (depending on the orientation of the primer relative to the designated allele) the 3' nucleotide of the allele-specific primer (i.e., either Primer 1 or Primer 2) that is specific for that allele.

Description of Table 4

Table 4 provides a list of LD SNPs that are related to and derived from certain interrogated SNPs. The interrogated SNPs, which are shown in column 1 (which indicates the hCV identification numbers of each interrogated SNP) and column 2 (which indicates the public rs identification numbers of each interrogated SNP) of Table 4, are statistically significantly associated with autoimmune disease, especially RA, as described and shown herein, particularly in Tables 5-16 and in the Examples section below. The LD SNPs are provided as an example of SNPs which can also serve as markers for disease association based on their being in LD with an interrogated SNP. The criteria and process of selecting such LD SNPs, including the calculation of the $r^2$ value and the threshold $r^2$ value, are described in Example 2, below.

In Table 4, the column labeled "Interrogated SNP" presents each marker as identified by its unique hCV identification number. The column labeled "Interrogated rs" presents the publicly known rs identification number for the corresponding hCV number. The column labeled "LD SNP" presents the hCV numbers of the LD SNPs that are derived from their corresponding interrogated SNPs. The column labeled "LD SNP rs" presents the publicly known rs identification number for the corresponding hCV number. The column labeled "Power" presents the level of power where the $r^2$ threshold is set. For example, when power is set at 0.51, the threshold $r^2$ value calculated therefrom is the minimum $r^2$ that an LD SNP must have in reference to an interrogated SNP, in order for the LD SNP to be classified as a marker capable of being associated with a disease phenotype at greater than 51% probability. The column labeled "Threshold $r^2$" presents the minimum value of $r^2$ that an LD SNP must meet in reference to an interrogated SNP in order to qualify as an LD SNP. The column labeled "$r^2$" presents the actual $r^2$ value of the LD SNP in reference to the interrogated SNP to which it is related.

Description of Tables 5-16

Tables 5-16 provide the results of statistical analyses for SNPs disclosed in Tables 1 and 2 (SNPs can be cross-referenced between all the tables herein based on their hCV and/or rs identification numbers). The results shown in Tables 5-16 provide support for the association of these SNPs with autoimmune disease, particularly RA.

Tables 5, 6, and 7 provide minor allele frequencies and allele-based association of chromosome 9q33 SNPs with RA for Sample Set 1 (Table 5), Sample Set 2 (Table 6), and Sample Set 3 (Table 7).

Table 8 provides demographic and clinical information for Sample Sets 1, 2, and 3. Table 9 provides results of combined analysis of 43 chromosome 9q33.2 SNPs genotyped in all three RA sample sets.

Table 10 provides three-SNP haplotypes for LD Block 1.

Table 11 provides diplotype analysis for the TRAF1-region SNPs rs2239657, rs7021880, and rs7021049.

Table 12 provides genotype counts for rs2239657, rs7021880, and rs7021049, stratified by the presence of rheumatoid factor.

Table 13 provides results of pairwise logistic regression analysis for 27 chromosome 9q33.2 SNPs.

Table 14 provides global P-values for backwards and forwards models using logistic regression.

Table 15 provides RA risk estimates for three loci-HLA-SE, PTPN22, and TRAF1-assuming a disease prevalence of 1%, 10% and 30%.

Table 16 provides HapMap SNPs in high linkage disequilibrium ($r^2 > 0.85$) with rs7021049 and rs2239657.

Throughout Tables 5-16, "OR" refers to the odds ratio, "95% CI" refers to the 95% confidence interval for the odds ratio, and $OR_{common}$ and $P_{comb}$ refer to the odds ratio and p-value, respectively, from a combined analysis. Odds ratios (OR) that are greater than one indicate that a given allele (or combination of alleles such as a haplotype or diplotype) is a risk allele (which may also be referred to as a susceptibility allele), whereas odds ratios or hazard ratios that are less than one indicate that a given allele is a non-risk allele (which may also be referred to as a protective allele). For a given risk allele, the other alternative allele at the SNP position (which can be derived from the information provided in Tables 1-2, for example) may be considered a non-risk allele. For a given non-risk allele, the other alternative allele at the SNP position may be considered a risk allele.

Thus, with respect to disease risk (e.g., autoimmune disease such as RA), if the odds ratio for a particular allele at a SNP position is greater than one, this indicates that an individual with this particular allele has a higher risk for the disease than an individual who has the other allele at the SNP position. In contrast, if the odds ratio for a particular allele is less than one, this indicates that an individual with this particular allele has a reduced risk for the disease compared with an individual who has the other allele at the SNP position.

DETAILED DESCRIPTION OF THE INVENTION

Figure 1:
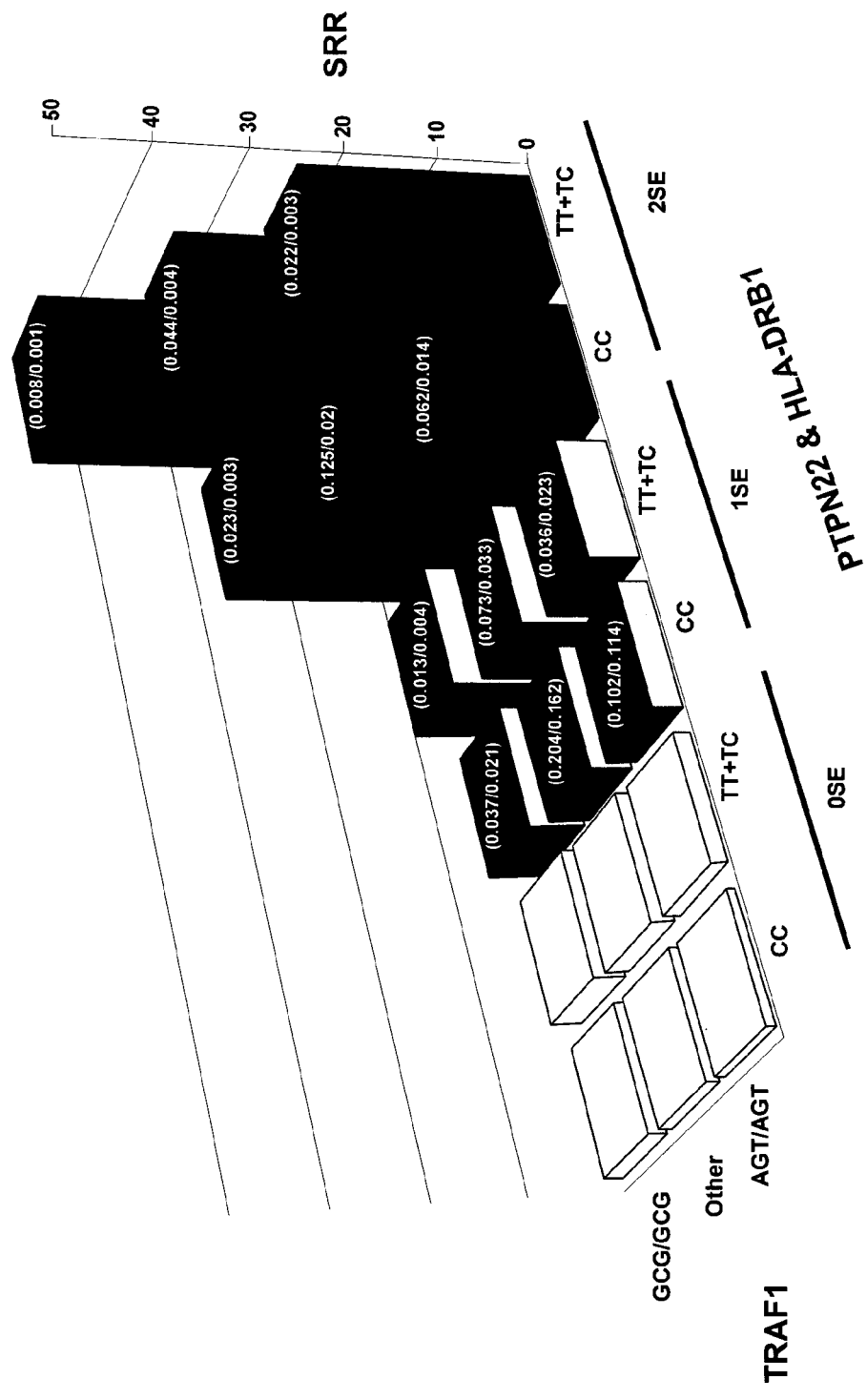
FIG. 1 shows the relative risk for RA plotted as a function of the genetic load of three validated RA risk variants in HLA-DRB1, PTPN22 and TRAF1. Individuals are classified according to the number of copies of the HLA-DRB1 shared epitope (0, 1 and 2) (SE-positive HLA-DRB1 alleles found in this sample set were: 0101, 0102, 0401, 0404, 0405, 0408 and 1001), carriage of the W620 PTPN22 missense SNP (TT+CT vs CC) and diplotypes at the TRAF1 SNPs, rs2239657, rs2021880 and rs7021049. The frequency of each combination of markers in cases and controls is indicated atop each bar.

The present invention provides SNPs associated with autoimmune disease, particularly rheumatoid arthritis (RA). The present invention further provides nucleic acid molecules containing these SNPs, methods and reagents for the detection of the SNPs disclosed herein, uses of these SNPs for the development of detection reagents, and assays or kits that utilize such reagents. The SNPs disclosed herein are useful for diagnosing, prognosing, screening for, and evaluating predisposition to autoimmune disease and related pathologies in humans. The SNPs disclosed herein may be used for predicting, screening for, and evaluating response to tumor necrosis factor (TNF) inhibitors, particularly treatment or prevention of autoimmune disease using TNF inhibitors, in humans. Furthermore, such SNPs and their encoded products are useful targets for the development of therapeutic and preventive agents.

A large number of SNPs have been identified from re-sequencing DNA from 39 individuals, and they are indicated as "Applera" SNP source in Tables 1-2. Their allele frequencies observed in each of the Caucasian and African-American ethnic groups are provided. Additional SNPs included herein were previously identified during "shotgun" sequencing and assembly of the human genome, and they are indicated as "Celera" SNP source in Tables 1 and 2. Furthermore, the information provided in Tables 1 and 2, particularly the allele frequency information obtained from 39 individuals and the identification of the precise position of each SNP within each gene/transcript, allows haplotypes (i.e., groups of SNPs that are co-inherited) to be readily inferred. The present invention encompasses SNP haplotypes, as well as individual SNPs.

Thus, the present invention provides individual SNPs associated with autoimmune disease (particularly RA), as well as combinations of SNPs and haplotypes, polymorphic/variant transcript sequences (SEQ ID NOS:1-16) and genomic sequences (SEQ ID NOS:78-91) containing SNPs, encoded amino acid sequences (SEQ ID NOS:17-32), and both transcript-based SNP context sequences (SEQ ID NOS:33-77) and genomic-based SNP context sequences (SEQ ID NOS: 92-584) (transcript sequences, protein sequences, and transcript-based SNP context sequences are provided in Table 1 and the Sequence Listing; genomic sequences and genomic-based SNP context sequences are provided in Table 2 and the Sequence Listing), methods of detecting these polymorphisms in a test sample, methods of determining the risk of an individual of having or developing autoimmune disease, methods of determining if an individual is likely to respond to a particular treatment such as TNF inhibitors (particularly for treating or preventing autoimmune disease), methods of screening for compounds useful for treating disorders associated with a variant gene/protein such as autoimmune disease, compounds identified by these screening methods, methods of using the disclosed SNPs to select a treatment/preventive strategy or therapeutic agent, methods of treating or preventing a disorder associated with a variant gene/protein, and methods of using the SNPs of the present invention for human identification.

The present invention further provides methods for selecting or formulating a treatment regimen (e.g., methods for determining whether or not to administer a TNF inhibitor to an individual having autoimmune disease, or who is at risk for developing autoimmune disease in the future, or who has previously had autoimmune disease, methods for selecting a particular TNF inhibitor-based treatment regimen such as dosage and frequency of administration of TNF inhibitor, or a particular form/type of TNF inhibitor such as a particular antibody, fusion protein, small molecule compound, nucleic acid agent, pharmaceutical formulation, etc., methods for administering an alternative, non-TNF inhibitor treatment to individuals who are predicted to be unlikely to respond positively to TNF inhibitor treatment, etc.), and methods for determining the likelihood of experiencing toxicity or other undesirable side effects from TNF inhibitor treatment, etc. The present invention also provides methods for selecting individuals to whom a TNF inhibitor or other therapeutic will be administered based on the individual's genotype, and methods for selecting individuals for a clinical trial of a TNF inhibitor or other therapeutic agent based on the genotypes of the individuals (e.g., selecting individuals to participate in the trial who are most likely to respond positively from the TNF inhibitor treatment and/or excluding individuals from the trial who are unlikely to respond positively from the TNF inhibitor treatment based on their SNP genotype(s), or selecting individuals who are unlikely to respond positively to TNF inhibitors based on their SNP genotype(s) to participate in a clinical trial of another type of drug that may benefit them).

The present invention may include novel SNPs associated with autoimmune disease, particularly RA, as well as SNPs that were previously known in the art, but were not previously known to be associated with autoimmune disease such as RA. Accordingly, the present invention may provide novel compositions and methods based on novel SNPs disclosed herein, and may also provide novel methods of using known, but previously unassociated, SNPs in methods relating to, for example, evaluating an individual's likelihood of having or developing autoimmune disease (particularly RA), predicting the likelihood of an individual experiencing a recurrence of autoimmune disease (e.g., experiencing recurrent RA), prognosing the severity of autoimmune disease in an individual, or prognosing an individual's recovery from autoimmune disease, and methods relating to evaluating an individual's likelihood of responding to TNF inhibitor treatment (particularly TNF inhibitor treatment, including preventive treatment, of autoimmune disease). In Tables 1 and 2, known SNPs are identified based on the public database in which they have been observed, which is indicated as one or more of the following SNP types: "dbSNP"=SNP observed in dbSNP, "HGBASE"=SNP observed in HGBASE, and "HGMD"=SNP observed in the Human Gene Mutation Database (HGMD).

Particular SNP alleles of the present invention can be associated with either an increased risk of having or developing autoimmune disease (e.g., RA) or increased likelihood of responding to a treatment (particularly TNF inhibitor treatment, including preventive treatment, of autoimmune disease), or a decreased risk of having or developing autoimmune disease or decreased likelihood of responding to a treatment (such as a TNF inhibitor). Thus, whereas certain SNPs (or their encoded products) can be assayed to determine whether an individual possesses a SNP allele that is indicative of an increased risk of having or developing autoimmune disease (e.g., RA) or increased likelihood of responding to TNF inhibitor treatment, other SNPs (or their encoded products) can be assayed to determine whether an individual possesses a SNP allele that is indicative of a decreased risk of having or developing autoimmune disease or decreased likelihood of responding to TNF inhibitor treatment. Similarly, particular SNP alleles of the present invention can be associated with either an increased or decreased likelihood of having a reccurrence of autoimmune disease (e.g., recurrent RA), of fully recovering from autoimmune disease, of experiencing toxic effects from a particular treatment or therapeutic compound, etc. The term "altered" may be used herein to encompass either of these two possibilities (e.g., an increased or a decreased risk/likelihood). SNP alleles that are associated with a decreased risk of having or developing autoimmune disease (such as RA) may be referred to as "protective" alleles, and SNP alleles that are associated with an increased risk of having or developing autoimmune disease may be referred to as "susceptibility" alleles, "risk" alleles, or "risk factors".

Those skilled in the art will readily recognize that nucleic acid molecules may be double-stranded molecules and that reference to a particular site on one strand refers, as well, to the corresponding site on a complementary strand. In defining a SNP position, SNP allele, or nucleotide sequence, reference to an adenine, a thymine (uridine), a cytosine, or a guanine at a particular site on one strand of a nucleic acid molecule also defines the thymine (uridine), adenine, guanine, or cytosine (respectively) at the corresponding site on a complementary strand of the nucleic acid molecule. Thus, reference may be made to either strand in order to refer to a particular SNP position, SNP allele, or nucleotide sequence. Probes and primers, may be designed to hybridize to either strand and SNP genotyping methods disclosed herein may generally target either strand. Throughout the specification, in identifying a SNP position, reference is generally made to the protein-encoding strand, only for the purpose of convenience.

References to variant peptides, polypeptides, or proteins of the present invention include peptides, polypeptides, proteins, or fragments thereof, that contain at least one amino acid residue that differs from the corresponding amino acid sequence of the art-known peptide/polypeptide/protein (the art-known protein may be interchangeably referred to as the "wild-type," "reference," or "normal" protein). Such variant peptides/polypeptides/proteins can result from a codon change caused by a nonsynonymous nucleotide substitution at a protein-coding SNP position (i.e., a missense mutation) disclosed by the present invention. Variant peptides/polypeptides/proteins of the present invention can also result from a nonsense mutation (i.e., a SNP that creates a premature stop codon, a SNP that generates a read-through mutation by abolishing a stop codon), or due to any SNP disclosed by the present invention that otherwise alters the structure, function, activity, or expression of a protein, such as a SNP in a regulatory region (e.g. a promoter or enhancer) or a SNP that leads to alternative or defective splicing, such as a SNP in an intron or a SNP at an exon/intron boundary. As used herein, the terms "polypeptide," "peptide," and "protein" are used interchangeably.

As used herein, an "allele" may refer to a nucleotide at a SNP position (wherein at least two alternative nucleotides are present in the population at the SNP position, in accordance with the inherent definition of a SNP) or may refer to an amino acid residue that is encoded by the codon which contains the SNP position (where the alternative nucleotides that are present in the population at the SNP position form alternative codons that encode different amino acid residues). An "allele" may also be referred to herein as a "variant". Also, an amino acid residue that is encoded by a codon containing a particular SNP may simply be referred to as being encoded by the SNP.

A phrase such as "as represented by", "as shown by", "as symbolized by", or "as designated by" may be used herein to refer to a SNP within a sequence (e.g., a polynucleotide context sequence surrounding a SNP), such as in the context of "a polymorphism as represented by position 101 of SEQ ID NO:X or its complement". Typically, the sequence surrounding a SNP may be recited when referring to a SNP, however the sequence is not intended as a structural limitation beyond the specific SNP position itself. Rather, the sequence is recited merely as a way of referring to the SNP (in this example, "SEQ ID NO:X or its complement" is recited in order to refer to the SNP located at position 101 of SEQ ID NO:X, but SEQ ID NO:X or its complement is not intended as a structural limitation beyond the specific SNP position itself). A SNP is a variation at a single nucleotide position and therefore it is customary to refer to context sequence (e.g., SEQ ID NO:X in this example) surrounding a particular SNP position in order to uniquely identify and refer to the SNP. Alternatively, a SNP can be referred to by a unique identification number such as a public "rs" identification number or an internal "hCV" identification number, such as provided herein for each SNP (e.g., in Tables 1-2). For example, in the instant application, "rs2239657", "hCV16175379", and "position 101 of SEQ ID NO:526" all refer to the same SNP.

As used herein, the term "benefit" (with respect to a preventive or therapeutic drug treatment) is defined as achieving a reduced risk for a disease that the drug is intended to treat or prevent (e.g., autoimmune disease such as RA) by administrating the drug treatment, compared with the risk for the disease in the absence of receiving the drug treatment (or receiving a placebo in lieu of the drug treatment) for the same genotype. The term "benefit" may be used herein interchangeably with terms such as "respond positively" or "positively respond".

As used herein, the terms "drug" and "therapeutic agent" are used interchangeably, and may include, but are not limited to, small molecule compounds, biologics (e.g., antibodies, proteins, protein fragments, fusion proteins, glycoproteins, etc.), nucleic acid agents (e.g., antisense, RNAi/siRNA, and microRNA molecules, etc.), vaccines, etc., which may be used for therapeutic and/or preventive treatment of a disease (e.g., autoimmune disease such as RA).

As used herein, "related pathologies" (e.g., in the context of "autoimmune disease and related pathologies") includes inflammatory disorders.

The various methods described herein, such as correlating the presence or absence of a polymorphism with an altered (e.g., increased or decreased) risk (or no altered risk) for autoimmune disease such as RA (and/or correlating the presence or absence of a polymorphism with the predicted response of an individual to a drug such as a TNF inhibitor), can be carried out by automated methods such as by using a computer (or other apparatus/devices such as biomedical devices, laboratory instrumentation, or other apparatus/devices having a computer processor) programmed to carry out any of the methods described herein. For example, computer software (which may be interchangeably referred to herein as a computer program) can perform the step of correlating the presence or absence of a polymorphism in an individual with an altered (e.g., increased or decreased) risk (or no altered risk) for autoimmune disease (particularly RA) for the individual. Computer software can also perform the step of correlating the presence or absence of a polymorphism in an individual with the predicted response of the individual to a drug such as a TNF inhibitor.

Therapeutics and Pharmacogenomics in Autoimmune Disease

Exemplary embodiments of the invention provide SNPs in (or in the vicinity of) TRAF1 and other genes (e.g., PHF19 and C5) that are associated with RA (as shown in the tables and described in the Examples section below, for example). These SNPs have a variety of therapeutic and pharmacogenomic uses related to the treatment of RA, as well as other autoimmune (and inflammatory) disorders. The RA-associated SNPs provided herein may be used, for example, to determine variability between different individuals in their response to RA therapy or other autoimmune (or inflammatory) disease therapy such as to predict whether an individual will respond positively to a particular therapy, to determine the most effective therapeutic agent (e.g., antibody, therapeutic protein or fusion protein, small molecule compound, nucleic acid agent, etc.) to use to treat an individual, to determine whether a particular therapeutic agent should or should not be administered to an individual (e.g., by predicting whether the individual is likely to positively respond to the therapy or by predicting whether the individual will experience toxic or other undesirable side effects or is unlikely to respond to the therapy), or to determine the therapeutic regimen to use for an individual such as the dosage or frequency of dosing of a therapeutic agent for a particular individual.

TNF inhibitors are an example of therapeutic agents for the treatment of RA or other autoimmune (or inflammatory) disorders which the SNPs provided herein can be used in conjunction with (e.g., to predict an individual's responsiveness). For example, TRAF1 SNP alleles disclosed herein may be associated with variability between individuals in their response to TNF inhibitors. Examples of TNF inhibitors include, but are not limited to, the monoclonal antibodies infliximab (Remicade®), adalimumab (Humira®), and golimumab (CNTO 148), and the fusion protein etanercept (Enbrel®).

Therapeutic agents that directly modulate (e.g., inhibit or stimulate) TRAF1 (or other TRAF proteins, or any of the other RA-associated genes disclosed herein such as PHF19 and C5) may be used to treat RA or other autoimmune/inflammatory disorders and, furthermore, therapeutic agents that target proteins that interact with TRAF1 or are otherwise in TRAF1 pathways may be used to indirectly modulate TRAF1 to thereby treat RA or other autoimmune/inflammatory disorders. Therapeutic agents such as these may be used in conjunction with the SNPs provided herein.

As an example, the RA-associated SNPs provided herein may be used to predict whether an individual will respond positively to TNF inhibitor therapy and/or to determine an effective dosage of this therapy. This facilitates decision making by medical practitioners, such as in deciding whether to administer this therapy to a particular individual or select another therapy that may be better suited to the individual, or to use a particular dosage, dosing schedule, or to modify other aspects of a therapeutic regimen to effectively treat the individual, for example.

In addition to medical treatment, these uses may also be applied, for example, in the context of clinical trials of a therapeutic agent (e.g., a therapeutic agent that targets TRAF1 or other TRAF protein, PHF19, or C5 for the treatment of RA or other autoimmune/inflammatory disorders), such as to include particular individuals in a clinical trial who are predicted to positively respond to the therapeutic agent based on the SNPs provided herein and/or to exclude particular individuals from a clinical trial who are predicted to not positively respond to the therapeutic agent based on the SNPs provided herein (and/or to include these particular individuals who are predicted to not positively respond to the therapeutic agent in a clinical trial for another therapeutic agent which they may benefit from). By using the SNPs provided herein to target a therapeutic agent to individuals who are more likely to positively respond to the agent, the therapeutic agent is more likely to succeed in clinical trials by showing positive efficacy and to therefore satisfy the FDA requirements for approval. Additionally, individuals who are more likely to experience toxic or other undesirable side effects may be excluded from being administered the therapeutic agent. Furthermore, by using the SNPs provided herein to determine an effective dosage or dosing frequency, for example, the therapeutic agent may be less likely to exhibit toxicity or other undesirable side effects, as well as more likely to achieve positive efficacy.

Reports, Transmission of Reports, Programmed Computers, and Business Methods

The results of a test (e.g., an individual's risk for autoimmune disease such as RA, or an individual's predicted drug responsiveness, based on assaying one or more SNPs disclosed herein, and/or an individual's allele(s)/genotype at one or more SNPs disclosed herein, etc.), and/or any other information pertaining to a test, may be referred to herein as a "report". A tangible report can optionally be generated as part of a testing process (which may be interchangeably referred to herein as "reporting", or as "providing" a report, "producing" a report, or "generating" a report).

Examples of tangible reports may include, but are not limited to, reports in paper (such as computer-generated printouts of test results) or equivalent formats and reports stored on computer readable medium (such as a CD, USB flash drive or other removable storage device, computer hard drive, or computer network server, etc.). Reports, particularly those stored on computer readable medium, can be part of a database, which may optionally be accessible via the internet (such as a database of patient records or genetic information stored on a computer network server, which may be a "secure database" that has security features that limit access to the report, such as to allow only the patient and the patient's medical practitioners to view the report while preventing other unauthorized individuals from viewing the report, for example). In addition to, or as an alternative to, generating a tangible report, reports can also be displayed on a computer screen (or the display of another electronic device or instrument).

A report can include, for example, an individual's risk for autoimmune disease, such as RA, or may just include the allele(s)/genotype that an individual carries at one or more SNPs disclosed herein, which may optionally be linked to information regarding the significance of having the allele(s)/genotype at the SNP (for example, a report on computer readable medium such as a network server may include hyperlink(s) to one or more journal publications or websites that describe the medical/biological implications, such as increased or decreased disease risk, for individuals having a certain allele/genotype at the SNP). Thus, for example, the report can include disease risk or other medical/biological significance (e.g., drug responsiveness, etc.) as well as optionally also including the allele/genotype information, or the report may just include allele/genotype information without including disease risk or other medical/biological significance (such that an individual viewing the report can use the allele/genotype information to determine the associated disease risk or other medical/biological significance from a source outside of the report itself, such as from a medical practitioner, publication, website, etc., which may optionally be linked to the report such as by a hyperlink).

A report can further be "transmitter" or "communicated" (these terms may be used herein interchangeably), such as to the individual who was tested, a medical practitioner (e.g., a doctor, nurse, clinical laboratory practitioner, genetic counselor, etc.), a healthcare organization, a clinical laboratory, and/or any other party or requester intended to view or possess the report. The act of "transmitting" or "communicating" a report can be by any means known in the art, based on the format of the report. Furthermore, "transmitting" or "communicating" a report can include delivering a report ("pushing") and/or retrieving ("pulling") a report. For example, reports can be transmitted/communicated by various means, including being physically transferred between parties (such as for reports in paper format) such as by being physically delivered from one party to another, or by being transmitted electronically or in signal form (e.g., via e-mail or over the internet, by facsimile, and/or by any wired or wireless communication methods known in the art) such as by being retrieved from a database stored on a computer network server, etc.

In certain exemplary embodiments, the invention provides computers (or other apparatus/devices such as biomedical devices or laboratory instrumentation) programmed to carry out the methods described herein. For example, in certain embodiments, the invention provides a computer programmed to receive (i.e., as input) the identity (e.g., the allele(s) or genotype at a SNP) of one or more SNPs disclosed herein and provide (i.e., as output) the disease risk (e.g., an individual's risk for autoimmune disease such as RA) or other result (e.g., disease diagnosis or prognosis, drug responsiveness, etc.) based on the identity of the SNP(s). Such output (e.g., communication of disease risk, disease diagnosis or prognosis, drug responsiveness, etc.) may be, for example, in the form of a report on computer readable medium, printed in paper form, and/or displayed on a computer screen or other display.

In various exemplary embodiments, the invention further provides methods of doing business (with respect to methods of doing business, the terms "individual" and "customer" are used herein interchangeably). For example, exemplary methods of doing business can comprise assaying one or more SNPs disclosed herein and providing a report that includes, for example, a customer's risk for autoimmune disease such as RA (based on which allele(s)/genotype is present at the assayed SNP(s)) and/or that includes the allele(s)/genotype at the assayed SNP(s) which may optionally be linked to information (e.g., journal publications, websites, etc.) pertaining to disease risk or other biological/medical significance such as by means of a hyperlink (the report may be provided, for example, on a computer network server or other computer readable medium that is internet-accessible, and the report may be included in a secure database that allows the customer to access their report while preventing other unauthorized individuals from viewing the report), and optionally transmitting the report. Customers (or another party who is associated with the customer, such as the customer's doctor, for example) can request/order (e.g., purchase) the test online via the internet (or by phone, mail order, at an outlet/store, etc.), for example, and a kit can be sent/delivered (or otherwise provided) to the customer (or another party on behalf of the customer, such as the customer's doctor, for example) for collection of a biological sample from the customer (e.g., a buccal swab for collecting buccal cells), and the customer (or a party who collects the customer's biological sample) can submit their biological samples for assaying (e.g., to a laboratory or party associated with the laboratory such as a party that accepts the customer samples on behalf of the laboratory, a party for whom the laboratory is under the control of (e.g., the laboratory carries out the assays by request of the party or under a contract with the party, for example), and/or a party that receives at least a portion of the customer's payment for the test). The report (e.g., results of the assay including, for example, the customer's disease risk and/or allele(s)/genotype at the assayed SNP(s)) may be provided to the customer by, for example, the laboratory that assays the SNP(s) or a party associated with the laboratory (e.g., a party that receives at least a portion of the customer's payment for the assay, or a party that requests the laboratory to carry out the assays or that contracts with the laboratory for the assays to be carried out) or a doctor or other medical practitioner who is associated with (e.g., employed by or having a consulting or contracting arrangement with) the laboratory or with a party associated with the laboratory, or the report may be provided to a third party (e.g., a doctor, genetic counselor, hospital, etc.) which optionally provides the report to the customer. In further embodiments, the customer may be a doctor or other medical practitioner, or a hospital, laboratory, medical insurance organization, or other medical organization that requests/orders (e.g., purchases) tests for the purposes of having other individuals (e.g., their patients or customers) assayed for one or more SNPs disclosed herein and optionally obtaining a report of the assay results.

In certain exemplary methods of doing business, kits for collecting a biological sample from a customer (e.g., a buccal swab for collecting buccal cells) are provided (e.g., for sale), such as at an outlet (e.g., a drug store, pharmacy, general merchandise store, or any other desirable outlet), online via the internet, by mail order, etc., whereby customers can obtain (e.g., purchase) the kits, collect their own biological samples, and submit (e.g., send/deliver via mail) their samples to a laboratory which assays the samples for one or more SNPs disclosed herein (such as to determine the customer's risk for autoimmune disease such as RA) and optionally provides a report to the customer (of the customer's disease risk based on their SNP genotype(s), for example) or provides the results of the assay to another party (e.g., a doctor, genetic counselor, hospital, etc.) which optionally provides a report to the customer (of the customer's disease risk based on their SNP genotype(s), for example).

Isolated Nucleic Acid Molecules and SNP Detection Reagents & Kits

Tables 1 and 2 provide a variety of information about each SNP of the present invention that is associated with autoimmune disease (particularly RA), including the transcript sequences (SEQ ID NOS:1-16), genomic sequences (SEQ ID NOS:78-91), and protein sequences (SEQ ID NOS:17-32) of the encoded gene products (with the SNPs indicated by IUB codes in the nucleic acid sequences). In addition, Tables 1 and 2 include SNP context sequences, which generally include 100 nucleotide upstream (5') plus 100 nucleotides downstream (3') of each SNP position (SEQ ID NOS:33-77 correspond to transcript-based SNP context sequences disclosed in Table 1, and SEQ ID NOS:92-584 correspond to genomic-based context sequences disclosed in Table 2), the alternative nucleotides (alleles) at each SNP position, and additional information about the variant where relevant, such as SNP type (coding, missense, splice site, UTR, etc.), human populations in which the SNP was observed, observed allele frequencies, information about the encoded protein, etc.

Isolated Nucleic Acid Molecules

The present invention provides isolated nucleic acid molecules that contain one or more SNPs disclosed Table 1 and/or Table 2. Isolated nucleic acid molecules containing one or more SNPs disclosed in at least one of Tables 1 and 2 may be interchangeably referred to throughout the present text as "SNP-containing nucleic acid molecules." Isolated nucleic acid molecules may optionally encode a full-length variant protein or fragment thereof. The isolated nucleic acid molecules of the present invention also include probes and primers (which are described in greater detail below in the section entitled "SNP Detection Reagents"), which may be used for assaying the disclosed SNPs, and isolated full-length genes, transcripts, cDNA molecules, and fragments thereof, which may be used for such purposes as expressing an encoded protein.

As used herein, an "isolated nucleic acid molecule" generally is one that contains a SNP of the present invention or one that hybridizes to such molecule such as a nucleic acid with a complementary sequence, and is separated from most other nucleic acids present in the natural source of the nucleic acid molecule. Moreover, an "isolated" nucleic acid molecule, such as a cDNA molecule containing a SNP of the present invention, can be substantially free of other cellular material, or culture medium when produced by recombinant techniques, or chemical precursors or other chemicals when chemically synthesized. A nucleic acid molecule can be fused to other coding or regulatory sequences and still be considered "isolated." Nucleic acid molecules present in non-human transgenic animals, which do not naturally occur in the animal, are also considered "isolated." For example, recombinant DNA molecules contained in a vector are considered "isolated." Further examples of "isolated" DNA molecules include recombinant DNA molecules maintained in heterologous host cells, and purified (partially or substantially) DNA molecules in solution. Isolated RNA molecules include in vivo or in vitro RNA transcripts of the isolated SNP-containing DNA molecules of the present invention. Isolated nucleic acid molecules according to the present invention further include such molecules produced synthetically.

Generally, an isolated SNP-containing nucleic acid molecule comprises one or more SNP positions disclosed by the present invention with flanking nucleotide sequences on either side of the SNP positions. A flanking sequence can include nucleotide residues that are naturally associated with the SNP site and/or heterologous nucleotide sequences. Preferably, the flanking sequence is up to about 500, 300, 100, 60, 50, 30, 25, 20, 15, 10, 8, or 4 nucleotides (or any other length in-between) on either side of a SNP position, or as long as the full-length gene or entire protein-coding sequence (or any portion thereof such as an exon), especially if the SNP-containing nucleic acid molecule is to be used to produce a protein or protein fragment.

For full-length genes and entire protein-coding sequences, a SNP flanking sequence can be, for example, up to about 5 KB, 4 KB, 3 KB, 2 KB, 1 KB on either side of the SNP. Furthermore, in such instances the isolated nucleic acid molecule comprises exonic sequences (including protein-coding and/or non-coding exonic sequences), but may also include intronic sequences. Thus, any protein coding sequence may be either contiguous or separated by introns. The important point is that the nucleic acid is isolated from remote and unimportant flanking sequences and is of appropriate length such that it can be subjected to the specific manipulations or uses described herein such as recombinant protein expression, preparation of probes and primers for assaying the SNP position, and other uses specific to the SNP-containing nucleic acid sequences.

An isolated SNP-containing nucleic acid molecule can comprise, for example, a full-length gene or transcript, such as a gene isolated from genomic DNA (e.g., by cloning or PCR amplification), a cDNA molecule, or an mRNA transcript molecule. Polymorphic transcript sequences are referred to in Table 1 and provided in the Sequence Listing (SEQ ID NOS:1-16), and polymorphic genomic sequences are referred to in Table 2 and provided in the Sequence Listing (SEQ ID NOS:78-91). Furthermore, fragments of such full-length genes and transcripts that contain one or more SNPs disclosed herein are also encompassed by the present invention, and such fragments may be used, for example, to express any part of a protein, such as a particular functional domain or an antigenic epitope.

Thus, the present invention also encompasses fragments of the nucleic acid sequences as disclosed in Tables 1 and 2 (transcript sequences are referred to in Table 1 as SEQ ID NOS:1-16, genomic sequences are referred to in Table 2 as SEQ ID NOS:78-91, transcript-based SNP context sequences are referred to in Table 1 as SEQ ID NOS:33-77, and genomic-based SNP context sequences are referred to in Table 2 as SEQ ID NOS:92-584) and their complements. The actual sequences referred to in the tables are provided in the Sequence Listing. A fragment typically comprises a contiguous nucleotide sequence at least about 8 or more nucleotides, more preferably at least about 12 or more nucleotides, and even more preferably at least about 16 or more nucleotides. Furthermore, a fragment could comprise at least about 18, 20, 22, 25, 30, 40, 50, 60, 80, 100, 150, 200, 250 or 500 nucleotides in length (or any other number in between). The length of the fragment will be based on its intended use. For example, the fragment can encode epitope-bearing regions of a variant peptide or regions of a variant peptide that differ from the normal/wild-type protein, or can be useful as a polynucleotide probe or primer. Such fragments can be isolated using the nucleotide sequences provided in Table 1 and/or Table 2 for the synthesis of a polynucleotide probe. A labeled probe can then be used, for example, to screen a cDNA library, genomic DNA library, or mRNA to isolate nucleic acid corresponding to the coding region. Further, primers can be used in amplification reactions, such as for purposes of assaying one or more SNPs sites or for cloning specific regions of a gene.

An isolated nucleic acid molecule of the present invention further encompasses a SNP-containing polynucleotide that is the product of any one of a variety of nucleic acid amplification methods, which are used to increase the copy numbers of a polynucleotide of interest in a nucleic acid sample. Such amplification methods are well known in the art, and they include but are not limited to, polymerase chain reaction (PCR) (U.S. Pat. Nos. 4,683,195 and 4,683,202; *PCR Technology: Principles and Applications for DNA Amplification*, ed. H. A. Erlich, Freeman Press, NY, N.Y. (1992)), ligase chain reaction (LCR) (Wu and Wallace, *Genomics* 4:560 (1989); Landegren et al., *Science* 241:1077 (1988)), strand displacement amplification (SDA) (U.S. Pat. Nos. 5,270,184 and 5,422,252), transcription-mediated amplification (TMA) (U.S. Pat. No. 5,399,491), linked linear amplification (LLA) (U.S. Pat. No. 6,027,923) and the like, and isothermal amplification methods such as nucleic acid sequence based amplification (NASBA) and self-sustained sequence replication (Guatelli et al., *Proc Natl Acad Sci USA* 87:1874 (1990)). Based on such methodologies, a person skilled in the art can readily design primers in any suitable regions 5' and 3' to a SNP disclosed herein. Such primers may be used to amplify DNA of any length so long that it contains the SNP of interest in its sequence.

As used herein, an "amplified polynucleotide" of the invention is a SNP-containing nucleic acid molecule whose amount has been increased at least two fold by any nucleic acid amplification method performed in vitro as compared to its starting amount in a test sample. In other preferred embodiments, an amplified polynucleotide is the result of at least ten fold, fifty fold, one hundred fold, one thousand fold, or even ten thousand fold increase as compared to its starting amount in a test sample. In a typical PCR amplification, a polynucleotide of interest is often amplified at least fifty thousand fold in amount over the unamplified genomic DNA, but the precise amount of amplification needed for an assay depends on the sensitivity of the subsequent detection method used.

Generally, an amplified polynucleotide is at least about 16 nucleotides in length. More typically, an amplified polynucleotide is at least about 20 nucleotides in length. In a preferred embodiment of the invention, an amplified polynucleotide is at least about 30 nucleotides in length. In a more preferred embodiment of the invention, an amplified polynucleotide is at least about 32, 40, 45, 50, or 60 nucleotides in length. In yet another preferred embodiment of the invention, an amplified polynucleotide is at least about 100, 200, 300, 400, or 500 nucleotides in length. While the total length of an amplified polynucleotide of the invention can be as long as an exon, an intron or the entire gene where the SNP of interest resides, an amplified product is typically up to about 1,000 nucleotides in length (although certain amplification methods may generate amplified products greater than 1000 nucleotide in length). More preferably, an amplified polynucleotide is not greater than about 600-700 nucleotides in length. It is understood that irrespective of the length of an amplified polynucleotide, a SNP of interest may be located anywhere along its sequence.

In a specific embodiment of the invention, the amplified product is at least about 201 nucleotides in length, comprises one of the transcript-based context sequences or the genomic-based context sequences shown in Tables 1 and 2. Such a product may have additional sequences on its 5' end or 3' end or both. In another embodiment, the amplified product is about 101 nucleotides in length, and it contains a SNP disclosed herein. Preferably, the SNP is located at the middle of the amplified product (e.g., at position 101 in an amplified product that is 201 nucleotides in length, or at position 51 in an amplified product that is 101 nucleotides in length), or within 1, 2, 3, 4, 5, 6, 7, 8, 9, 10, 12, 15, or 20 nucleotides from the middle of the amplified product. However, as indicated above, the SNP of interest may be located anywhere along the length of the amplified product.

The present invention provides isolated nucleic acid molecules that comprise, consist of; or consist essentially of one or more polynucleotide sequences that contain one or more SNPs disclosed herein, complements thereof, and SNP-containing fragments thereof.

Accordingly, the present invention provides nucleic acid molecules that consist of any of the nucleotide sequences shown in Table 1 and/or Table 2 (transcript sequences are referred to in Table 1 as SEQ ID NOS:1-16, genomic sequences are referred to in Table 2 as SEQ ID NOS:78-91, transcript-based SNP context sequences are referred to in Table 1 as SEQ ID NOS:33-77, and genomic-based SNP context sequences are referred to in Table 2 as SEQ ID NOS: 92-584), or any nucleic acid molecule that encodes any of the variant proteins referred to in Table 1 (SEQ ID NOS:17-32). The actual sequences referred to in the tables are provided in the Sequence Listing. A nucleic acid molecule consists of a nucleotide sequence when the nucleotide sequence is the complete nucleotide sequence of the nucleic acid molecule.

The present invention further provides nucleic acid molecules that consist essentially of any of the nucleotide sequences referred to in Table 1 and/or Table 2 (transcript sequences are referred to in Table 1 as SEQ ID NOS:1-16, genomic sequences are referred to in Table 2 as SEQ ID NOS:78-91, transcript-based SNP context sequences are referred to in Table 1 as SEQ ID NOS:33-77, and genomic-based SNP context sequences are referred to in Table 2 as SEQ ID NOS:92-584), or any nucleic acid molecule that encodes any of the variant proteins referred to in Table 1 (SEQ ID NOS:17-32). The actual sequences referred to in the tables are provided in the Sequence Listing. A nucleic acid molecule consists essentially of a nucleotide sequence when such a nucleotide sequence is present with only a few additional nucleotide residues in the final nucleic acid molecule.

The present invention further provides nucleic acid molecules that comprise any of the nucleotide sequences shown in Table 1 and/or Table 2 or a SNP-containing fragment thereof (transcript sequences are referred to in Table 1 as SEQ ID NOS:1-16, genomic sequences are referred to in Table 2 as SEQ ID NOS:78-91, transcript-based SNP context sequences are referred to in Table 1 as SEQ ID NOS:33-77, and genomic-based SNP context sequences are referred to in Table 2 as SEQ ID NOS:92-584), or any nucleic acid molecule that encodes any of the variant proteins provided in Table 1 (SEQ ID NOS:17-32). The actual sequences referred to in the tables are provided in the Sequence Listing. A nucleic acid molecule comprises a nucleotide sequence when the nucleotide sequence is at least part of the final nucleotide sequence of the nucleic acid molecule. In such a fashion, the nucleic acid molecule can be only the nucleotide sequence or have additional nucleotide residues, such as residues that are naturally associated with it or heterologous nucleotide sequences. Such a nucleic acid molecule can have one to a few additional nucleotides or can comprise many more additional nucleotides. A brief description of how various types of these nucleic acid molecules can be readily made and isolated is provided below, and such techniques are well known to those of ordinary skill in the art. Sambrook and Russell, *Molecular Cloning: A Laboratory Manual*, Cold Spring Harbor Press, N.Y. (2000).

The isolated nucleic acid molecules can encode mature proteins plus additional amino or carboxyl-terminal amino acids or both, or amino acids interior to the mature peptide (when the mature form has more than one peptide chain, for instance). Such sequences may play a role in processing of a protein from precursor to a mature form, facilitate protein trafficking, prolong or shorten protein half-life, or facilitate manipulation of a protein for assay or production. As generally is the case in situ, the additional amino acids may be processed away from the mature protein by cellular enzymes.

Thus, the isolated nucleic acid molecules include, but are not limited to, nucleic acid molecules having a sequence encoding a peptide alone, a sequence encoding a mature peptide and additional coding sequences such as a leader or secretory sequence (e.g., a pre-pro or pro-protein sequence), a sequence encoding a mature peptide with or without additional coding sequences, plus additional non-coding sequences, for example introns and non-coding 5' and 3' sequences such as transcribed but untranslated sequences that play a role in, for example, transcription, mRNA processing (including splicing and polyadenylation signals), ribosome binding, and/or stability of mRNA. In addition, the nucleic acid molecules may be fused to heterologous marker sequences encoding, for example, a peptide that facilitates purification.

Isolated nucleic acid molecules can be in the form of RNA, such as mRNA, or in the form DNA, including cDNA and genomic DNA, which may be obtained, for example, by molecular cloning or produced by chemical synthetic techniques or by a combination thereof. Sambrook and Russell, *Molecular Cloning: A Laboratory Manual*, Cold Spring Harbor Press, N.Y. (2000). Furthermore, isolated nucleic acid molecules, particularly SNP detection reagents such as probes and primers, can also be partially or completely in the form of one or more types of nucleic acid analogs, such as peptide nucleic acid (PNA). U.S. Pat. Nos. 5,539,082; 5,527, 675; 5,623,049; and 5,714,331. The nucleic acid, especially DNA, can be double-stranded or single-stranded. Single-stranded nucleic acid can be the coding strand (sense strand) or the complementary non-coding strand (anti-sense strand). DNA, RNA, or PNA segments can be assembled, for example, from fragments of the human genome (in the case of DNA or RNA) or single nucleotides, short oligonucleotide linkers, or from a series of oligonucleotides, to provide a synthetic nucleic acid molecule. Nucleic acid molecules can be readily synthesized using the sequences provided herein as a reference; oligonucleotide and PNA oligomer synthesis techniques are well known in the art. See, e.g., Corey, "Peptide nucleic acids: expanding the scope of nucleic acid recognition," *Trends Biotechnol* 15(6):224-9 (June 1997), and Hyrup et al., "Peptide nucleic acids (PNA): synthesis, properties and potential applications," *Bioorg Med Chem* 4(1):5-23) (January 1996). Furthermore, large-scale automated oligonucleotide/PNA synthesis (including synthesis on an array or bead surface or other solid support) can readily be accomplished using commercially available nucleic acid synthesizers, such as the Applied Biosystems (Foster City, Calif.) 3900 High-Throughput DNA Synthesizer or Expedite 8909 Nucleic Acid Synthesis System, and the sequence information provided herein.

The present invention encompasses nucleic acid analogs that contain modified, synthetic, or non-naturally occurring nucleotides or structural elements or other alternative/modified nucleic acid chemistries known in the art. Such nucleic acid analogs are useful, for example, as detection reagents (e.g., primers/probes) for detecting one or more SNPs identified in Table 1 and/or Table 2. Furthermore, kits/systems (such as beads, arrays, etc.) that include these analogs are also encompassed by the present invention. For example, PNA oligomers that are based on the polymorphic sequences of the present invention are specifically contemplated. PNA oligomers are analogs of DNA in which the phosphate backbone is replaced with a peptide-like backbone. Lagriffoul et al., *Bioorganic & Medicinal Chemistry Letters* 4:1081-1082 (1994); Petersen et al., *Bioorganic & Medicinal Chemistry Letters* 6:793-796 (1996); Kumar et al., *Organic Letters* 3(9): 1269-1272 (2001); WO 96/04000. PNA hybridizes to complementary RNA or DNA with higher affinity and specificity than conventional oligonucleotides and oligonucleotide analogs. The properties of PNA enable novel molecular biology and biochemistry applications unachievable with traditional oligonucleotides and peptides.

Additional examples of nucleic acid modifications that improve the binding properties and/or stability of a nucleic acid include the use of base analogs such as inosine, intercalators (U.S. Pat. No. 4,835,263) and the minor groove binders (U.S. Pat. No. 5,801,115). Thus, references herein to nucleic acid molecules, SNP-containing nucleic acid molecules, SNP detection reagents (e.g., probes and primers), oligonucleotides/polynucleotides include PNA oligomers and other nucleic acid analogs. Other examples of nucleic acid analogs and alternative/modified nucleic acid chemistries known in the art are described in *Current Protocols in Nucleic Acid Chemistry*, John Wiley & Sons, N.Y. (2002).

The present invention further provides nucleic acid molecules that encode fragments of the variant polypeptides disclosed herein as well as nucleic acid molecules that encode obvious variants of such variant polypeptides. Such nucleic acid molecules may be naturally occurring, such as paralogs (different locus) and orthologs (different organism), or may be constructed by recombinant DNA methods or by chemical synthesis. Non-naturally occurring variants may be made by mutagenesis techniques, including those applied to nucleic acid molecules, cells, or organisms. Accordingly, the variants can contain nucleotide substitutions, deletions, inversions and insertions (in addition to the SNPs disclosed in Tables 1 and 2). Variation can occur in either or both the coding and non-coding regions. The variations can produce conservative and/or non-conservative amino acid substitutions.

Further variants of the nucleic acid molecules disclosed in Tables 1 and 2, such as naturally occurring allelic variants (as well as orthologs and paralogs) and synthetic variants produced by mutagenesis techniques, can be identified and/or produced using methods well known in the art. Such further variants can comprise a nucleotide sequence that shares at least 70-80%, 80-85%, 85-90%, 91%, 92%, 93%, 94%, 95%, 96%, 97%, 98%, or 99% sequence identity with a nucleic acid sequence disclosed in Table 1 and/or Table 2 (or a fragment thereof) and that includes a novel SNP allele disclosed in Table 1 and/or Table 2. Further, variants can comprise a nucleotide sequence that encodes a polypeptide that shares at least 70-80%, 80-85%, 85-90%, 91%, 92%, 93%, 94%, 95%, 96%, 97%, 98%, or 99% sequence identity with a polypeptide sequence disclosed in Table 1 (or a fragment thereof) and that includes a novel SNP allele disclosed in Table 1 and/or Table 2. Thus, an aspect of the present invention that is specifically contemplated are isolated nucleic acid molecules that have a certain degree of sequence variation compared with the sequences shown in Tables 1-2, but that contain a novel SNP allele disclosed herein. In other words, as long as an isolated nucleic acid molecule contains a novel SNP allele disclosed herein, other portions of the nucleic acid molecule that flank the novel SNP allele can vary to some degree from the specific transcript, genomic, and context sequences referred to and shown in Tables 1 and 2, and can encode a polypeptide that varies to some degree from the specific polypeptide sequences referred to in Table 1.

To determine the percent identity of two amino acid sequences or two nucleotide sequences of two molecules that share sequence homology, the sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, at least 30%, 40%, 50%, 60%, 70%, 80%, or 90% or more of the length of a reference sequence is aligned for comparison purposes. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein, amino acid or nucleic acid "identity" is equivalent to amino acid or nucleic acid "homology"). The percent identity between the two sequences is a function of the number of identical positions shared by the sequences, taking into account the number of gaps, and the length of each gap, which need to be introduced for optimal alignment of the two sequences.

The comparison of sequences and determination of percent identity between two sequences can be accomplished using a mathematical algorithm. *Computational Molecular Biology*, A. M. Lesk, ed., Oxford University Press, N.Y. (1988); *Biocomputing: Informatics and Genome Projects*, D. W. Smith, ed., Academic Press, N.Y. (1993); *Computer Analysis of Sequence Data, Part* 1, A. M. Griffin and H. G. Griffin, eds., Humana Press, N.J. (1994); *Sequence Analysis in Molecular Biology*, G. von Heinje, ed., Academic Press, N.Y. (1987); and *Sequence Analysis Primer*, M. Gribskov and J. Devereux, eds., M. Stockton Press, N.Y. (1991). In a preferred embodiment, the percent identity between two amino acid sequences is determined using the Needleman and Wunsch algorithm (*J Mol Biol* (48):444-453 (1970)) which has been incorporated into the GAP program in the GCG software package, using either a Blossom 62 matrix or a PAM250 matrix, and a gap weight of 16, 14, 12, 10, 8, 6, or 4 and a length weight of 1, 2, 3, 4, 5, or 6.

In yet another preferred embodiment, the percent identity between two nucleotide sequences is determined using the GAP program in the GCG software package using a NWSgapdna.CMP matrix and a gap weight of 40, 50, 60, 70, or 80 and a length weight of 1, 2, 3, 4, 5, or 6. J. Devereux et al., *Nucleic Acids Res.* 12(1):387 (1984). In another embodiment, the percent identity between two amino acid or nucleotide sequences is determined using the algorithm of E. Myers and W. Miller (CABIOS 4:11-17 (1989)) which has been incorporated into the ALIGN program (version 2.0), using a PAM120 weight residue table, a gap length penalty of 12, and a gap penalty of 4.

The nucleotide and amino acid sequences of the present invention can further be used as a "query sequence" to perform a search against sequence databases; for example, to identify other family members or related sequences. Such searches can be performed using the NBLAST and XBLAST programs (version 2.0). Altschul et al., *J Mol Biol* 215:403-10 (1990). BLAST nucleotide searches can be performed with the NBLAST program, score=100, wordlength=12 to obtain nucleotide sequences homologous to the nucleic acid molecules of the invention. BLAST protein searches can be performed with the XBLAST program, score=50, wordlength=3 to obtain amino acid sequences homologous to the proteins of the invention. To obtain gapped alignments for comparison purposes, Gapped BLAST can be utilized. Altschul et al., *Nucleic Acids Res* 25(17):3389-3402 (1997). When utilizing BLAST and gapped BLAST programs, the default parameters of the respective programs (e.g., XBLAST and NBLAST) can be used. In addition to BLAST, examples of other search and sequence comparison programs used in the art include, but are not limited to, FASTA (Pearson, *Methods Mol Biol* 25, 365-389 (1994)) and KERR (Dufresne et al., *Nat Biotechnol* 20(12):1269-71 (December 2002)). For further information regarding bioinformatics techniques, see *Current Protocols in Bioinformatics*, John Wiley & Sons, Inc., N.Y.

The present invention further provides non-coding fragments of the nucleic acid molecules disclosed in Table 1 and/or Table 2. Preferred non-coding fragments include, but are not limited to, promoter sequences, enhancer sequences, intronic sequences, 5' untranslated regions (UTRs), 3' untranslated regions, gene modulating sequences and gene termination sequences. Such fragments are useful, for example, in controlling heterologous gene expression and in developing screens to identify gene-modulating agents.

SNP Detection Reagents

In a specific aspect of the present invention, the SNPs disclosed in Table 1 and/or Table 2, and their associated transcript sequences (referred to in Table 1 as SEQ ID NOS: 1-16), genomic sequences (referred to in Table 2 as SEQ ID NOS:78-91), and context sequences (transcript-based context sequences are referred to in Table 1 as SEQ ID NOS:33-77; genomic-based context sequences are provided in Table 2 as SEQ ID NOS:92-584), can be used for the design of SNP detection reagents. The actual sequences referred to in the tables are provided in the Sequence Listing. As used herein, a "SNP detection reagent" is a reagent that specifically detects a specific target SNP position disclosed herein, and that is preferably specific for a particular nucleotide (allele) of the target SNP position (i.e., the detection reagent preferably can differentiate between different alternative nucleotides at a target SNP position, thereby allowing the identity of the nucleotide present at the target SNP position to be determined). Typically, such detection reagent hybridizes to a target SNP-containing nucleic acid molecule by complementary base-pairing in a sequence specific manner, and discriminates the target variant sequence from other nucleic acid sequences such as an art-known form in a test sample. An example of a detection reagent is a probe that hybridizes to a target nucleic acid containing one or more of the SNPs referred to in Table 1 and/or Table 2. In a preferred embodiment, such a probe can differentiate between nucleic acids having a particular nucleotide (allele) at a target SNP position from other nucleic acids that have a different nucleotide at the same target SNP position. In addition, a detection reagent may hybridize to a specific region 5' and/or 3' to a SNP position, particularly a region corresponding to the context sequences referred to in Table 1 and/or Table 2 (transcript-based context sequences are referred to in Table 1 as SEQ ID NOS:33-77; genomic-based context sequences are referred to in Table 2 as SEQ ID NOS: 92-584). Another example of a detection reagent is a primer that acts as an initiation point of nucleotide extension along a complementary strand of a target polynucleotide. The SNP sequence information provided herein is also useful for designing primers, e.g. allele-specific primers, to amplify (e.g., using PCR) any SNP of the present invention.

In one preferred embodiment of the invention, a SNP detection reagent is an isolated or synthetic DNA or RNA polynucleotide probe or primer or PNA oligomer, or a combination of DNA, RNA and/or PNA, that hybridizes to a segment of a target nucleic acid molecule containing a SNP identified in Table 1 and/or Table 2. A detection reagent in the form of a polynucleotide may optionally contain modified base analogs, intercalators or minor groove binders. Multiple detection reagents such as probes may be, for example, affixed to a solid support (e.g., arrays or beads) or supplied in solution (e.g. probe/primer sets for enzymatic reactions such as PCR, RT-PCR, TaqMan assays, or primer-extension reactions) to form a SNP detection kit.

A probe or primer typically is a substantially purified oligonucleotide or PNA oligomer. Such oligonucleotide typically comprises a region of complementary nucleotide sequence that hybridizes under stringent conditions to at least about 8, 10, 12, 16, 18, 20, 22, 25, 30, 40, 50, 55, 60, 65, 70, 80, 90, 100, 120 (or any other number in-between) or more consecutive nucleotides in a target nucleic acid molecule. Depending on the particular assay, the consecutive nucleotides can either include the target SNP position, or be a specific region in close enough proximity 5' and/or 3' to the SNP position to carry out the desired assay.

Other preferred primer and probe sequences can readily be determined using the transcript sequences (SEQ ID NOS:1-16), genomic sequences (SEQ ID NOS:78-91), and SNP context sequences (transcript-based context sequences are referred to in Table 1 as SEQ ID NOS:33-77; genomic-based context sequences are referred to in Table 2 as SEQ ID NOS: 92-584) disclosed in the Sequence Listing and in Tables 1 and 2. The actual sequences referred to in the tables are provided in the Sequence Listing. It will be apparent to one of skill in the art that such primers and probes are directly useful as reagents for genotyping the SNPs of the present invention, and can be incorporated into any kit/system format.

In order to produce a probe or primer specific for a target SNP-containing sequence, the gene/transcript and/or context sequence surrounding the SNP of interest is typically examined using a computer algorithm that starts at the 5' or at the 3' end of the nucleotide sequence. Typical algorithms will then identify oligomers of defined length that are unique to the gene/SNP context sequence, have a GC content within a range suitable for hybridization, lack predicted secondary structure that may interfere with hybridization, and/or possess other desired characteristics or that lack other undesired characteristics.

A primer or probe of the present invention is typically at least about 8 nucleotides in length. In one embodiment of the invention, a primer or a probe is at least about 10 nucleotides in length. In a preferred embodiment, a primer or a probe is at least about 12 nucleotides in length. In a more preferred embodiment, a primer or probe is at least about 16, 17, 18, 19, 20, 21, 22, 23, 24 or 25 nucleotides in length. While the maximal length of a probe can be as long as the target sequence to be detected, depending on the type of assay in which it is employed, it is typically less than about 50, 60, 65, or 70 nucleotides in length. In the case of a primer, it is typically less than about 30 nucleotides in length. In a specific preferred embodiment of the invention, a primer or a probe is within the length of about 18 and about 28 nucleotides. However, in other embodiments, such as nucleic acid arrays and other embodiments in which probes are affixed to a substrate, the probes can be longer, such as on the order of 30-70, 75, 80, 90, 100, or more nucleotides in length (see the section below entitled "SNP Detection Kits and Systems").

For analyzing SNPs, it may be appropriate to use oligonucleotides specific for alternative SNP alleles. Such oligonucleotides that detect single nucleotide variations in target sequences may be referred to by such terms as "allele-specific oligonucleotides," "allele-specific probes," or "allele-specific primers." The design and use of allele-specific probes for analyzing polymorphisms is described in, e.g., Mutation Detection: A Practical Approach, Cotton et al., eds., Oxford University Press (1998); Saiki et al., Nature 324:163-166 (1986); Dattagupta, EP235,726; and Saiki, WO 89/11548.

While the design of each allele-specific primer or probe depends on variables such as the precise composition of the nucleotide sequences flanking a SNP position in a target nucleic acid molecule, and the length of the primer or probe, another factor in the use of primers and probes is the stringency of the condition under which the hybridization between the probe or primer and the target sequence is performed. Higher stringency conditions utilize buffers with lower ionic strength and/or a higher reaction temperature, and tend to require a more perfect match between probe/primer and a target sequence in order to form a stable duplex. If the stringency is too high, however, hybridization may not occur at all. In contrast, lower stringency conditions utilize buffers with higher ionic strength and/or a lower reaction temperature, and permit the formation of stable duplexes with more mismatched bases between a probe/primer and a target sequence. By way of example and not limitation, exemplary conditions for high stringency hybridization conditions using an allele-specific probe are as follows: prehybridization with a solution containing 5× standard saline phosphate EDTA (SSPE), 0.5% $NaDodSO_4$ (SDS) at 55° C., and incubating probe with target nucleic acid molecules in the same solution at the same temperature, followed by washing with a solution containing 2×SSPE, and 0.1% SDS at 55° C. or room temperature.

Moderate stringency hybridization conditions may be used for allele-specific primer extension reactions with a solution containing, e.g., about 50 mM KCl at about 46° C. Alternatively, the reaction may be carried out at an elevated temperature such as 60° C. In another embodiment, a moderately stringent hybridization condition suitable for oligonucleotide ligation assay (OLA) reactions wherein two probes are ligated if they are completely complementary to the target sequence may utilize a solution of about 100 mM KCl at a temperature of 46° C.

In a hybridization-based assay, allele-specific probes can be designed that hybridize to a segment of target DNA from one individual but do not hybridize to the corresponding segment from another individual due to the presence of different polymorphic forms (e.g., alternative SNP alleles/ nucleotides) in the respective DNA segments from the two individuals. Hybridization conditions should be sufficiently stringent that there is a significant detectable difference in hybridization intensity between alleles, and preferably an essentially binary response, whereby a probe hybridizes to only one of the alleles or significantly more strongly to one allele. While a probe may be designed to hybridize to a target sequence that contains a SNP site such that the SNP site aligns anywhere along the sequence of the probe, the probe is preferably designed to hybridize to a segment of the target sequence such that the SNP site aligns with a central position of the probe (e.g., a position within the probe that is at least three nucleotides from either end of the probe). This design of probe generally achieves good discrimination in hybridization between different allelic forms.

In another embodiment, a probe or primer may be designed to hybridize to a segment of target DNA such that the SNP aligns with either the 5' most end or the 3' most end of the probe or primer. In a specific preferred embodiment that is particularly suitable for use in a oligonucleotide ligation assay (U.S. Pat. No. 4,988,617), the 3'most nucleotide of the probe aligns with the SNP position in the target sequence.

Oligonucleotide probes and primers may be prepared by methods well known in the art. Chemical synthetic methods include, but are not limited to, the phosphotriester method described by Narang et al., Methods in Enzymology 68:90 (1979); the phosphodiester method described by Brown et al., Methods in Enzymology 68:109 (1979); the diethylphosphoamidate method described by Beaucage et al., Tetrahedron Letters 22:1859 (1981); and the solid support method described in U.S. Pat. No. 4,458,066.

Allele-specific probes are often used in pairs (or, less commonly, in sets of 3 or 4, such as if a SNP position is known to have 3 or 4 alleles, respectively, or to assay both strands of a nucleic acid molecule for a target SNP allele), and such pairs may be identical except for a one nucleotide mismatch that represents the allelic variants at the SNP position. Commonly, one member of a pair perfectly matches a reference form of a target sequence that has a more common SNP allele (i.e., the allele that is more frequent in the target population) and the other member of the pair perfectly matches a form of the target sequence that has a less common SNP allele (i.e., the allele that is rarer in the target population). In the case of an array, multiple pairs of probes can be immobilized on the same support for simultaneous analysis of multiple different polymorphisms.

In one type of PCR-based assay, an allele-specific primer hybridizes to a region on a target nucleic acid molecule that overlaps a SNP position and only primes amplification of an allelic form to which the primer exhibits perfect complementarity. Gibbs, Nucleic Acid Res 17:2427-2448 (1989). Typically, the primer's 3'-most nucleotide is aligned with and complementary to the SNP position of the target nucleic acid molecule. This primer is used in conjunction with a second primer that hybridizes at a distal site. Amplification proceeds from the two primers, producing a detectable product that indicates which allelic form is present in the test sample. A control is usually performed with a second pair of primers, one of which shows a single base mismatch at the polymorphic site and the other of which exhibits perfect complementarity to a distal site. The single-base mismatch prevents amplification or substantially reduces amplification efficiency, so that either no detectable product is formed or it is formed in lower amounts or at a slower pace. The method generally works most effectively when the mismatch is at the 3'-most position of the oligonucleotide (i.e., the 3'-most position of the oligonucleotide aligns with the target SNP position) because this position is most destabilizing to elongation from the primer (see, e.g., WO 93/22456). This PCR-based assay can be utilized as part of the TaqMan assay, described below.

In a specific embodiment of the invention, a primer of the invention contains a sequence substantially complementary to a segment of a target SNP-containing nucleic acid molecule except that the primer has a mismatched nucleotide in one of the three nucleotide positions at the 3'-most end of the primer, such that the mismatched nucleotide does not base pair with a particular allele at the SNP site. In a preferred embodiment, the mismatched nucleotide in the primer is the second from the last nucleotide at the 3'-most position of the primer. In a more preferred embodiment, the mismatched nucleotide in the primer is the last nucleotide at the 3'-most position of the primer.

In another embodiment of the invention, a SNP detection reagent of the invention is labeled with a fluorogenic reporter dye that emits a detectable signal. While the preferred reporter dye is a fluorescent dye, any reporter dye that can be attached to a detection reagent such as an oligonucleotide probe or primer is suitable for use in the invention. Such dyes include, but are not limited to, Acridine, AMCA, BODIPY, Cascade Blue, Cy2, Cy3, Cy5, Cy7, Dabcyl, Edans, Eosin, Erythrosin, Fluorescein, 6-Fam, Tet, Joe, Hex, Oregon Green, Rhodamine, Rhodol Green, Tamra, Rox, and Texas Red.

In yet another embodiment of the invention, the detection reagent may be further labeled with a quencher dye such as Tamra, especially when the reagent is used as a self-quenching probe such as a TaqMan (U.S. Pat. Nos. 5,210,015 and 5,538,848) or Molecular Beacon probe (U.S. Pat. Nos. 5,118, 801 and 5,312,728), or other stemless or linear beacon probe (Livak et al., *PCR Method Appl* 4:357-362 (1995); Tyagi et al., *Nature Biotechnology* 14:303-308 (1996); Nazarenko et al., *Nucl Acids Res* 25:2516-2521 (1997); U.S. Pat. Nos. 5,866,336 and 6,117,635.

The detection reagents of the invention may also contain other labels, including but not limited to, biotin for streptavidin binding, hapten for antibody binding, and oligonucleotide for binding to another complementary oligonucleotide such as pairs of zipcodes.

The present invention also contemplates reagents that do not contain (or that are complementary to) a SNP nucleotide identified herein but that are used to assay one or more SNPs disclosed herein. For example, primers that flank, but do not hybridize directly to a target SNP position provided herein are useful in primer extension reactions in which the primers hybridize to a region adjacent to the target SNP position (i.e., within one or more nucleotides from the target SNP site). During the primer extension reaction, a primer is typically not able to extend past a target SNP site if a particular nucleotide (allele) is present at that target SNP site, and the primer extension product can be detected in order to determine which SNP allele is present at the target SNP site. For example, particular ddNTPs are typically used in the primer extension reaction to terminate primer extension once a ddNTP is incorporated into the extension product (a primer extension product which includes a ddNTP at the 3'-most end of the primer extension product, and in which the ddNTP is a nucleotide of a SNP disclosed herein, is a composition that is specifically contemplated by the present invention). Thus, reagents that bind to a nucleic acid molecule in a region adjacent to a SNP site and that are used for assaying the SNP site, even though the bound sequences do not necessarily include the SNP site itself, are also contemplated by the present invention.

SNP Detection Kits and Systems

A person skilled in the art will recognize that, based on the SNP and associated sequence information disclosed herein, detection reagents can be developed and used to assay any SNP of the present invention individually or in combination, and such detection reagents can be readily incorporated into one of the established kit or system formats which are well known in the art. The terms "kits" and "systems," as used herein in the context of SNP detection reagents, are intended to refer to such things as combinations of multiple SNP detection reagents, or one or more SNP detection reagents in combination with one or more other types of elements or components (e.g., other types of biochemical reagents, containers, packages such as packaging intended for commercial sale, substrates to which SNP detection reagents are attached, electronic hardware components, etc.). Accordingly, the present invention further provides SNP detection kits and systems, including but not limited to, packaged probe and primer sets (e.g. TaqMan probe/primer sets), arrays/microarrays of nucleic acid molecules, and beads that contain one or more probes, primers, or other detection reagents for detecting one or more SNPs of the present invention. The kits/systems can optionally include various electronic hardware components; for example, arrays ("DNA chips") and microfluidic systems ("lab-on-a-chip" systems) provided by various manufacturers typically comprise hardware components. Other kits/systems (e.g., probe/primer sets) may not include electronic hardware components, but may be comprised of, for example, one or more SNP detection reagents (along with, optionally, other biochemical reagents) packaged in one or more containers.

In some embodiments, a SNP detection kit typically contains one or more detection reagents and other components (e.g. a buffer, enzymes such as DNA polymerases or ligases, chain extension nucleotides such as deoxynucleotide triphosphates, and in the case of Sanger-type DNA sequencing reactions, chain terminating nucleotides, positive control sequences, negative control sequences, and the like) necessary to carry out an assay or reaction, such as amplification and/or detection of a SNP-containing nucleic acid molecule. A kit may further contain means for determining the amount of a target nucleic acid, and means for comparing the amount with a standard, and can comprise instructions for using the kit to detect the SNP-containing nucleic acid molecule of interest. In one embodiment of the present invention, kits are provided which contain the necessary reagents to carry out one or more assays to detect one or more SNPs disclosed herein. In a preferred embodiment of the present invention, SNP detection kits/systems are in the form of nucleic acid arrays, or compartmentalized kits, including microfluidic/lab-on-a-chip systems.

SNP detection kits/systems may contain, for example, one or more probes, or pairs of probes, that hybridize to a nucleic acid molecule at or near each target SNP position. Multiple pairs of allele-specific probes may be included in the kit/system to simultaneously assay large numbers of SNPs, at least one of which is a SNP of the present invention. In some kits/systems, the allele-specific probes are immobilized to a substrate such as an array or bead. For example, the same substrate can comprise allele-specific probes for detecting at least 1; 10; 100; 1000; 10,000; 100,000 (or any other number in-between) or substantially all of the SNPs shown in Table 1 and/or Table 2.

The terms "arrays," "microarrays," and "DNA chips" are used herein interchangeably to refer to an array of distinct polynucleotides affixed to a substrate, such as glass, plastic, paper, nylon or other type of membrane, filter, chip, or any other suitable solid support. The polynucleotides can be synthesized directly on the substrate, or synthesized separate from the substrate and then affixed to the substrate. In one embodiment, the microarray is prepared and used according to the methods described in Chee et al., U.S. Pat. No. 5,837, 832 and PCT application WO95/11995; D. J. Lockhart et al., *Nat Biotech* 14:1675-1680 (1996); and M. Schena et al., *Proc Natl Acad Sci* 93:10614-10619 (1996), all of which are incorporated herein in their entirety by reference. In other embodiments, such arrays are produced by the methods described by Brown et al., U.S. Pat. No. 5,807,522.

Nucleic acid arrays are reviewed in the following references: Zammatteo et al., "New chips for molecular biology and diagnostics," *Biotechnol Annu Rev* 8:85-101 (2002); Sosnowski et al., "Active microelectronic array system for DNA hybridization, genotyping and pharmacogenomic applications," *Psychiatr Genet.* 12(4):181-92 (December 2002); Heller, "DNA microarray technology: devices, systems, and applications," *Annu Rev Biomed Eng* 4:129-53 (2002); Epub Mar. 22, 2002; Kolchinsky et al., "Analysis of SNPs and other genomic variations using gel-based chips," *Hum Mutat* 19(4): 343-60 (April 2002); and McGall et al., "High-density genechip oligonucleotide probe arrays," *Adv Biochem Eng Biotechnol* 77:21-42 (2002).

Any number of probes, such as allele-specific probes, may be implemented in an array, and each probe or pair of probes can hybridize to a different SNP position. In the case of polynucleotide probes, they can be synthesized at designated areas (or synthesized separately and then affixed to designated areas) on a substrate using a light-directed chemical process. Each DNA chip can contain, for example, thousands to millions of individual synthetic polynucleotide probes arranged in a grid-like pattern and miniaturized (e.g., to the size of a dime). Preferably, probes are attached to a solid support in an ordered, addressable array.

A microarray can be composed of a large number of unique, single-stranded polynucleotides, usually either synthetic antisense polynucleotides or fragments of cDNAs, fixed to a solid support. Typical polynucleotides are preferably about 6-60 nucleotides in length, more preferably about 15-30 nucleotides in length, and most preferably about 18-25 nucleotides in length. For certain types of microarrays or other detection kits/systems, it may be preferable to use oligonucleotides that are only about 7-20 nucleotides in length. In other types of arrays, such as arrays used in conjunction with chemiluminescent detection technology, preferred probe lengths can be, for example, about 15-80 nucleotides in length, preferably about 50-70 nucleotides in length, more preferably about 55-65 nucleotides in length, and most preferably about 60 nucleotides in length. The microarray or detection kit can contain polynucleotides that cover the known 5' or 3' sequence of a gene/transcript or target SNP site, sequential polynucleotides that cover the full-length sequence of a gene/transcript; or unique polynucleotides selected from particular areas along the length of a target gene/transcript sequence, particularly areas corresponding to one or more SNPs disclosed in Table 1 and/or Table 2. Polynucleotides used in the microarray or detection kit can be specific to a SNP or SNPs of interest (e.g., specific to a particular SNP allele at a target SNP site, or specific to particular SNP alleles at multiple different SNP sites), or specific to a polymorphic gene/transcript or genes/transcripts of interest.

Hybridization assays based on polynucleotide arrays rely on the differences in hybridization stability of the probes to perfectly matched and mismatched target sequence variants. For SNP genotyping, it is generally preferable that stringency conditions used in hybridization assays are high enough such that nucleic acid molecules that differ from one another at as little as a single SNP position can be differentiated (e.g., typical SNP hybridization assays are designed so that hybridization will occur only if one particular nucleotide is present at a SNP position, but will not occur if an alternative nucleotide is present at that SNP position). Such high stringency conditions may be preferable when using, for example, nucleic acid arrays of allele-specific probes for SNP detection. Such high stringency conditions are described in the preceding section, and are well known to those skilled in the art and can be found in, for example, *Current Protocols in Molecular Biology* 6.3.1-6.3.6, John Wiley & Sons, N.Y. (1989).

In other embodiments, the arrays are used in conjunction with chemiluminescent detection technology. The following patents and patent applications, which are all hereby incorporated by reference, provide additional information pertaining to chemiluminescent detection. U.S. patent applications that describe chemiluminescent approaches for microarray detection: 10/620,332 and 10/620,333. U.S. patents that describe methods and compositions of dioxetane for performing chemiluminescent detection: Nos. 6,124,478; 6,107,024; 5,994,073; 5,981,768; 5,871,938; 5,843,681; 5,800,999 and 5,773,628. And the U.S. published application that discloses methods and compositions for microarray controls: US2002/0110828.

In one embodiment of the invention, a nucleic acid array can comprise an array of probes of about 15-25 nucleotides in length. In further embodiments, a nucleic acid array can comprise any number of probes, in which at least one probe is capable of detecting one or more SNPs disclosed in Table 1 and/or Table 2, and/or at least one probe comprises a fragment of one of the sequences selected from the group consisting of those disclosed in Table 1, Table 2, the Sequence Listing, and sequences complementary thereto, said fragment comprising at least about 8 consecutive nucleotides, preferably 10, 12, 15, 16, 18, 20, more preferably 22, 25, 30, 40, 47, 50, 55, 60, 65, 70, 80, 90, 100, or more consecutive nucleotides (or any other number in-between) and containing (or being complementary to) a novel SNP allele disclosed in Table 1 and/or Table 2. In some embodiments, the nucleotide complementary to the SNP site is within 5, 4, 3, 2, or 1 nucleotide from the center of the probe, more preferably at the center of said probe.

A polynucleotide probe can be synthesized on the surface of the substrate by using a chemical coupling procedure and an ink jet application apparatus, as described in PCT application WO95/251116 (Baldeschweiler et al.) which is incorporated herein in its entirety by reference. In another aspect, a "gridded" array analogous to a dot (or slot) blot may be used to arrange and link cDNA fragments or oligonucleotides to the surface of a substrate using a vacuum system, thermal, UV, mechanical or chemical bonding procedures. An array, such as those described above, may be produced by hand or by using available devices (slot blot or dot blot apparatus), materials (any suitable solid support), and machines (including robotic instruments), and may contain 8, 24, 96, 384, 1536, 6144 or more polynucleotides, or any other number which lends itself to the efficient use of commercially available instrumentation.

Using such arrays or other kits/systems, the present invention provides methods of identifying the SNPs disclosed herein in a test sample. Such methods typically involve incubating a test sample of nucleic acids with an array comprising one or more probes corresponding to at least one SNP position of the present invention, and assaying for binding of a nucleic acid from the test sample with one or more of the probes. Conditions for incubating a SNP detection reagent (or a kit/system that employs one or more such SNP detection reagents) with a test sample vary. Incubation conditions depend on such factors as the format employed in the assay, the detection methods employed, and the type and nature of the detection reagents used in the assay. One skilled in the art will recognize that any one of the commonly available hybridization, amplification and array assay formats can readily be adapted to detect the SNPs disclosed herein.

A SNP detection kit/system of the present invention may include components that are used to prepare nucleic acids from a test sample for the subsequent amplification and/or detection of a SNP-containing nucleic acid molecule. Such sample preparation components can be used to produce nucleic acid extracts (including DNA and/or RNA), proteins or membrane extracts from any bodily fluids (such as blood, serum, plasma, urine, saliva, phlegm, gastric juices, semen, tears, sweat, etc.), skin, hair, cells (especially nucleated cells) such as buccal cells (e.g., as obtained by buccal swabs), biopsies, or tissue specimens. The test samples used in the above-described methods will vary based on such factors as the assay format, nature of the detection method, and the specific tissues, cells or extracts used as the test sample to be assayed. Methods of preparing nucleic acids, proteins, and cell extracts are well known in the art and can be readily adapted to obtain a sample that is compatible with the system utilized. Automated sample preparation systems for extracting nucleic acids from a test sample are commercially available, and examples are Qiagen's BioRobot 9600, Applied Biosystems' PRISM™ 6700 sample preparation system, and Roche Molecular Systems' COBAS AmpliPrep System.

Another form of kit contemplated by the present invention is a compartmentalized kit. A compartmentalized kit includes any kit in which reagents are contained in separate containers. Such containers include, for example, small glass containers, plastic containers, strips of plastic, glass or paper, or arraying material such as silica. Such containers allow one to efficiently transfer reagents from one compartment to another compartment such that the test samples and reagents are not cross-contaminated, or from one container to another vessel not included in the kit, and the agents or solutions of each container can be added in a quantitative fashion from one compartment to another or to another vessel. Such containers may include, for example, one or more containers which will accept the test sample, one or more containers which contain at least one probe or other SNP detection reagent for detecting one or more SNPs of the present invention, one or more containers which contain wash reagents (such as phosphate buffered saline, Tris-buffers, etc.), and one or more containers which contain the reagents used to reveal the presence of the bound probe or other SNP detection reagents. The kit can optionally further comprise compartments and/or reagents for, for example, nucleic acid amplification or other enzymatic reactions such as primer extension reactions, hybridization, ligation, electrophoresis (preferably capillary electrophoresis), mass spectrometry, and/or laser-induced fluorescent detection. The kit may also include instructions for using the kit. Exemplary compartmentalized kits include microfluidic devices known in the art. See, e.g., Weigl et al., "Lab-on-a-chip for drug development," *Adv Drug Deliv Rev* 55(3):349-77 (February 2003). In such microfluidic devices, the containers may be referred to as, for example, microfluidic "compartments," "chambers," or "channels."

Microfluidic devices, which may also be referred to as "lab-on-a-chip" systems, biomedical micro-electro-mechanical systems (bioMEMs), or multicomponent integrated systems, are exemplary kits/systems of the present invention for analyzing SNPs. Such systems miniaturize and compartmentalize processes such as probe/target hybridization, nucleic acid amplification, and capillary electrophoresis reactions in a single functional device. Such microfluidic devices typically utilize detection reagents in at least one aspect of the system, and such detection reagents may be used to detect one or more SNPs of the present invention. One example of a microfluidic system is disclosed in U.S. Pat. No. 5,589,136, which describes the integration of PCR amplification and capillary electrophoresis in chips. Exemplary microfluidic systems comprise a pattern of microchannels designed onto a glass, silicon, quartz, or plastic wafer included on a microchip. The movements of the samples may be controlled by electric, electroosmotic or hydrostatic forces applied across different areas of the microchip to create functional microscopic valves and pumps with no moving parts. Varying the voltage can be used as a means to control the liquid flow at intersections between the micro-machined channels and to change the liquid flow rate for pumping across different sections of the microchip. See, for example, U.S. Pat. Nos. 6,153,073, Dubrow et al., and 6,156,181, Parce et al.

For genotyping SNPs, an exemplary microfluidic system may integrate, for example, nucleic acid amplification, primer extension, capillary electrophoresis, and a detection method such as laser induced fluorescence detection. In a first step of an exemplary process for using such an exemplary system, nucleic acid samples are amplified, preferably by PCR. Then, the amplification products are subjected to automated primer extension reactions using ddNTPs (specific fluorescence for each ddNTP) and the appropriate oligonucleotide primers to carry out primer extension reactions which hybridize just upstream of the targeted SNP. Once the extension at the 3' end is completed, the primers are separated from the unincorporated fluorescent ddNTPs by capillary electrophoresis. The separation medium used in capillary electrophoresis can be, for example, polyacrylamide, polyethyleneglycol or dextran. The incorporated ddNTPs in the single nucleotide primer extension products are identified by laser-induced fluorescence detection. Such an exemplary microchip can be used to process, for example, at least 96 to 384 samples, or more, in parallel.

Uses of Nucleic Acid Molecules

The nucleic acid molecules of the present invention have a variety of uses, especially for the diagnosis, prognosis, treatment, and prevention of autoimmune disease (particularly RA), and for predicting drug response, particularly response to TNF inhibitors. For example, the nucleic acid molecules of the invention are useful for predicting an individual's risk for developing autoimmune disease (particularly the risk for RA), for prognosing the progression of autoimmune disease (e.g., the severity or consequences of RA) in an individual, in evaluating the likelihood of an individual who has autoimmune disease (or who is at increased risk for autoimmune disease) of responding to treatment (or prevention) of autoimmune disease with TNF inhibitor, and/or predicting the likelihood that the individual will experience toxicity or other undesirable side effects from the TNF inhibitor treatment, etc. For example, the nucleic acid molecules are useful as hybridization probes, such as for genotyping SNPs in messenger RNA, transcript, cDNA, genomic DNA, amplified DNA or other nucleic acid molecules, and for isolating full-length cDNA and genomic clones encoding the variant peptides disclosed in Table 1 as well as their orthologs.

A probe can hybridize to any nucleotide sequence along the entire length of a nucleic acid molecule referred to in Table 1 and/or Table 2. Preferably, a probe of the present invention hybridizes to a region of a target sequence that encompasses a SNP position indicated in Table 1 and/or Table 2. More preferably, a probe hybridizes to a SNP-containing target sequence in a sequence-specific manner such that it distinguishes the target sequence from other nucleotide sequences which vary from the target sequence only by which nucleotide is present at the SNP site. Such a probe is particularly useful for detecting the presence of a SNP-containing nucleic acid in a test sample, or for determining which nucleotide (allele) is present at a particular SNP site (i.e., genotyping the SNP site).

A nucleic acid hybridization probe may be used for determining the presence, level, form, and/or distribution of nucleic acid expression. The nucleic acid whose level is determined can be DNA or RNA. Accordingly, probes specific for the SNPs described herein can be used to assess the presence, expression and/or gene copy number in a given cell, tissue, or organism. These uses are relevant for diagnosis of disorders involving an increase or decrease in gene expression relative to normal levels. In vitro techniques for detection of mRNA include, for example, Northern blot hybridizations and in situ hybridizations. In vitro techniques for detecting DNA include Southern blot hybridizations and in situ hybridizations. Sambrook and Russell, *Molecular Cloning: A Laboratory Manual*, Cold Spring Harbor Press, N.Y. (2000).

Probes can be used as part of a diagnostic test kit for identifying cells or tissues in which a variant protein is expressed, such as by measuring the level of a variant protein-encoding nucleic acid (e.g., mRNA) in a sample of cells from a subject or determining if a polynucleotide contains a SNP of interest.

Thus, the nucleic acid molecules of the invention can be used as hybridization probes to detect the SNPs disclosed herein, thereby determining whether an individual with the polymorphism(s) is at risk for developing autoimmune disease (or has already developed early stage autoimmune disease), or the likelihood that an individual will respond positively to TNF inhibitor treatment (including preventive treatment) of autoimmune disease. Detection of a SNP associated with a disease phenotype provides a diagnostic tool for an active disease and/or genetic predisposition to the disease.

Furthermore, the nucleic acid molecules of the invention are therefore useful for detecting a gene (gene information is disclosed in Table 2, for example) which contains a SNP disclosed herein and/or products of such genes, such as expressed mRNA transcript molecules (transcript information is disclosed in Table 1, for example), and are thus useful for detecting gene expression. The nucleic acid molecules can optionally be implemented in, for example, an array or kit format for use in detecting gene expression.

The nucleic acid molecules of the invention are also useful as primers to amplify any given region of a nucleic acid molecule, particularly a region containing a SNP identified in Table 1 and/or Table 2.

The nucleic acid molecules of the invention are also useful for constructing recombinant vectors (described in greater detail below). Such vectors include expression vectors that express a portion of, or all of, any of the variant peptide sequences referred to in Table 1. Vectors also include insertion vectors, used to integrate into another nucleic acid molecule sequence, such as into the cellular genome, to alter in situ expression of a gene and/or gene product. For example, an endogenous coding sequence can be replaced via homologous recombination with all or part of the coding region containing one or more specifically introduced SNPs.

The nucleic acid molecules of the invention are also useful for expressing antigenic portions of the variant proteins, particularly antigenic portions that contain a variant amino acid sequence (e.g., an amino acid substitution) caused by a SNP disclosed in Table 1 and/or Table 2.

The nucleic acid molecules of the invention are also useful for constructing vectors containing a gene regulatory region of the nucleic acid molecules of the present invention.

The nucleic acid molecules of the invention are also useful for designing ribozymes corresponding to all, or a part, of an mRNA molecule expressed from a SNP-containing nucleic acid molecule described herein.

The nucleic acid molecules of the invention are also useful for constructing host cells expressing a part, or all, of the nucleic acid molecules and variant peptides.

The nucleic acid molecules of the invention are also useful for constructing transgenic animals expressing all, or a part, of the nucleic acid molecules and variant peptides. The production of recombinant cells and transgenic animals having nucleic acid molecules which contain the SNPs disclosed in Table 1 and/or Table 2 allows, for example, effective clinical design of treatment compounds and dosage regimens.

The nucleic acid molecules of the invention are also useful in assays for drug screening to identify compounds that, for example, modulate nucleic acid expression.

The nucleic acid molecules of the invention are also useful in gene therapy in patients whose cells have aberrant gene expression. Thus, recombinant cells, which include a patient's cells that have been engineered ex vivo and returned to the patient, can be introduced into an individual where the recombinant cells produce the desired protein to treat the individual.

SNP Genotyping Methods

The process of determining which nucleotide(s) is/are present at each of one or more SNP positions (such as a SNP position disclosed in Table 1 and/or Table 2), for either or both alleles, may be referred to by such phrases as SNP genotyping, determining the "identity" of a SNP, determining the "content" of a SNP, or determining which nucleotide(s)/allele(s) is/are present at a SNP position. Thus, these terms can refer to detecting a single allele (nucleotide) at a SNP position or can encompass detecting both alleles (nucleotides) at a SNP position (such as to determine the homozygous or heterozygous state of a SNP position). Furthermore, these terms may also refer to detecting an amino acid residue encoded by a SNP (such as alternative amino acid residues that are encoded by different codons created by alternative nucleotides at a missense SNP position, for example).

The present invention provides methods of SNP genotyping, such as for use in evaluating an individual's risk for developing autoimmune disease (particularly RA), for evaluating an individual's prognosis for disease severity and recovery, for predicting the likelihood that an individual who has previously had autoimmune disease (such as RA) will have a recurrence of autoimmune disease again in the future, for implementing a preventive or treatment regimen for an individual based on that individual having an increased susceptibility for developing autoimmune disease (e.g., increased risk for RA), in evaluating an individual's likelihood of responding to TNF inhibitor treatment (particularly for treating or preventing autoimmune disease), in selecting a treatment or preventive regimen (e.g., in deciding whether or not to administer TNF inhibitor treatment to an individual having autoimmune disease, or who is at increased risk for developing autoimmune disease in the future), or in formulating or selecting a particular TNF inhibitor-based treatment or preventive regimen such as dosage and/or frequency of administration of TNF inhibitor treatment or choosing which form/type of TNF inhibitor to be administered, such as a particular pharmaceutical composition or antibody, fusion protein, small molecule compound, nucleic acid agent, etc.), determining the likelihood of experiencing toxicity or other undesirable side effects from TNF inhibitor treatment, or selecting individuals for a clinical trial of a TNF inhibitor (e.g., selecting individuals to participate in the trial who are most likely to respond positively from the TNF inhibitor treatment and/or excluding individuals from the trial who are unlikely to respond positively from the TNF inhibitor treatment based on their SNP genotype(s), or selecting individuals who are unlikely to respond positively to TNF inhibitors based on their SNP genotype(s) to participate in a clinical trial of another type of drug that may benefit them), etc.

Nucleic acid samples can be genotyped to determine which allele(s) is/are present at any given genetic region (e.g., SNP position) of interest by methods well known in the art. The neighboring sequence can be used to design SNP detection reagents such as oligonucleotide probes, which may optionally be implemented in a kit format. Exemplary SNP genotyping methods are described in Chen et al., "Single nucleotide polymorphism genotyping: biochemistry, protocol, cost and throughput," *Pharmacogenomics J* 3(2):77-96 (2003); Kwok et al., "Detection of single nucleotide polymorphisms," *Curr Issues Mol Biol* 5(2):43-60 (April 2003); Shi, "Technologies for individual genotyping: detection of genetic polymorphisms in drug targets and disease genes," *Am J Pharmacogenomics* 2(3):197-205 (2002); and Kwok, "Methods for genotyping single nucleotide polymorphisms," *Annu Rev Genomics Hum Genet.* 2:235-58 (2001). Exemplary techniques for high-throughput SNP genotyping are described in Marnellos, "High-throughput SNP analysis for genetic association studies," *Curr Opin Drug Discov Devel* 6(3):317-21 (May 2003). Common SNP genotyping methods include, but are not limited to, TaqMan assays, molecular beacon assays, nucleic acid arrays, allele-specific primer extension, allele-specific PCR, arrayed primer extension, homogeneous primer extension assays, primer extension with detection by mass spectrometry, pyrosequencing, multiplex primer extension sorted on genetic arrays, ligation with rolling circle amplification, homogeneous ligation, OLA (U.S. Pat. No. 4,988,167), multiplex ligation reaction sorted on genetic arrays, restriction-fragment length polymorphism, single base extension-tag assays, and the Invader assay. Such methods may be used in combination with detection mechanisms such as, for example, luminescence or chemiluminescence detection, fluorescence detection, time-resolved fluorescence detection, fluorescence resonance energy transfer, fluorescence polarization, mass spectrometry, and electrical detection.

Various methods for detecting polymorphisms include, but are not limited to, methods in which protection from cleavage agents is used to detect mismatched bases in RNA/RNA or RNA/DNA duplexes (Myers et al., *Science* 230:1242 (1985); Cotton et al., *PNAS* 85:4397 (1988); and Saleeba et al., *Meth. Enzymol* 217:286-295 (1992)), comparison of the electrophoretic mobility of variant and wild type nucleic acid molecules (Orita et al., *PNAS* 86:2766 (1989); Cotton et al., *Mutat Res* 285:125-144 (1993); and Hayashi et al., *Genet Anal Tech Appl* 9:73-79 (1992)), and assaying the movement of polymorphic or wild-type fragments in polyacrylamide gels containing a gradient of denaturant using denaturing gradient gel electrophoresis (DGGE) (Myers et al., *Nature* 313:495 (1985)). Sequence variations at specific locations can also be assessed by nuclease protection assays such as RNase and S1 protection or chemical cleavage methods.

In a preferred embodiment, SNP genotyping is performed using the TaqMan assay, which is also known as the 5' nuclease assay (U.S. Pat. Nos. 5,210,015 and 5,538,848). The TaqMan assay detects the accumulation of a specific amplified product during PCR. The TaqMan assay utilizes an oligonucleotide probe labeled with a fluorescent reporter dye and a quencher dye. The reporter dye is excited by irradiation at an appropriate wavelength, it transfers energy to the quencher dye in the same probe via a process called fluorescence resonance energy transfer (FRET). When attached to the probe, the excited reporter dye does not emit a signal. The proximity of the quencher dye to the reporter dye in the intact probe maintains a reduced fluorescence for the reporter. The reporter dye and quencher dye may be at the 5' most and the 3' most ends, respectively, or vice versa. Alternatively, the reporter dye may be at the 5' or 3' most end while the quencher dye is attached to an internal nucleotide, or vice versa. In yet another embodiment, both the reporter and the quencher may be attached to internal nucleotides at a distance from each other such that fluorescence of the reporter is reduced.

During PCR, the 5' nuclease activity of DNA polymerase cleaves the probe, thereby separating the reporter dye and the quencher dye and resulting in increased fluorescence of the reporter. Accumulation of PCR product is detected directly by monitoring the increase in fluorescence of the reporter dye. The DNA polymerase cleaves the probe between the reporter dye and the quencher dye only if the probe hybridizes to the target SNP-containing template which is amplified during PCR, and the probe is designed to hybridize to the target SNP site only if a particular SNP allele is present.

Preferred TaqMan primer and probe sequences can readily be determined using the SNP and associated nucleic acid sequence information provided herein. A number of computer programs, such as Primer Express (Applied Biosystems, Foster City, Calif.), can be used to rapidly obtain optimal primer/probe sets. It will be apparent to one of skill in the art that such primers and probes for detecting the SNPs of the present invention are useful in, for example, screening for individuals who are susceptible to developing autoimmune disease (particularly RA) and related pathologies, or in screening individuals who have autoimmune disease (or who are susceptible to autoimmune disease) for their likelihood of responding to TNF inhibitor treatment. These probes and primers can be readily incorporated into a kit format. The present invention also includes modifications of the Taqman assay well known in the art such as the use of Molecular Beacon probes (U.S. Pat. Nos. 5,118,801 and 5,312,728) and other variant formats (U.S. Pat. Nos. 5,866,336 and 6,117, 635).

Another preferred method for genotyping the SNPs of the present invention is the use of two oligonucleotide probes in an OLA (see, e.g., U.S. Pat. No. 4,988,617). In this method, one probe hybridizes to a segment of a target nucleic acid with its 3' most end aligned with the SNP site. A second probe hybridizes to an adjacent segment of the target nucleic acid molecule directly 3' to the first probe. The two juxtaposed probes hybridize to the target nucleic acid molecule, and are ligated in the presence of a linking agent such as a ligase if there is perfect complementarity between the 3' most nucleotide of the first probe with the SNP site. If there is a mismatch, ligation would not occur. After the reaction, the ligated probes are separated from the target nucleic acid molecule, and detected as indicators of the presence of a SNP.

The following patents, patent applications, and published international patent applications, which are all hereby incorporated by reference, provide additional information pertaining to techniques for carrying out various types of OLA. The following U.S. patents describe OLA strategies for performing SNP detection: U.S. Pat. Nos. 6,027,889; 6,268,148; 5,494,810; 5,830,711 and 6,054,564. WO 97/31256 and WO 00/56927 describe OLA strategies for performing SNP detection using universal arrays, wherein a zipcode sequence can be introduced into one of the hybridization probes, and the resulting product, or amplified product, hybridized to a universal zip code array. U.S. application US01/17329 (and 09/584,905) describes OLA (or LDR) followed by PCR, wherein zipcodes are incorporated into OLA probes, and amplified PCR products are determined by electrophoretic or universal zipcode array readout. U.S. applications 60/427,818, 60/445,636, and 60/445,494 describe SNPlex methods and software for multiplexed SNP detection using OLA followed by PCR, wherein zipcodes are incorporated into OLA probes, and amplified PCR products are hybridized with a zipchute reagent, and the identity of the SNP determined from electrophoretic readout of the zipchute. In some embodiments, OLA is carried out prior to PCR (or another method of nucleic acid amplification). In other embodiments, PCR (or another method of nucleic acid amplification) is carried out prior to OLA.

Another method for SNP genotyping is based on mass spectrometry. Mass spectrometry takes advantage of the unique mass of each of the four nucleotides of DNA. SNPs can be unambiguously genotyped by mass spectrometry by measuring the differences in the mass of nucleic acids having alternative SNP alleles. MALDI-TOF (Matrix Assisted Laser Desorption Ionization—Time of Flight) mass spectrometry technology is preferred for extremely precise determinations of molecular mass, such as SNPs. Numerous approaches to SNP analysis have been developed based on mass spectrometry. Preferred mass spectrometry-based methods of SNP genotyping include primer extension assays, which can also be utilized in combination with other approaches, such as traditional gel-based formats and microarrays.

Typically, the primer extension assay involves designing and annealing a primer to a template PCR amplicon upstream (5') from a target SNP position. A mix of dideoxynucleotide triphosphates (ddNTPs) and/or deoxynucleotide triphosphates (dNTPs) are added to a reaction mixture containing template (e.g., a SNP-containing nucleic acid molecule which has typically been amplified, such as by PCR), primer, and DNA polymerase. Extension of the primer terminates at the first position in the template where a nucleotide complementary to one of the ddNTPs in the mix occurs. The primer can be either immediately adjacent (i.e., the nucleotide at the 3' end of the primer hybridizes to the nucleotide next to the target SNP site) or two or more nucleotides removed from the SNP position. If the primer is several nucleotides removed from the target SNP position, the only limitation is that the template sequence between the 3' end of the primer and the SNP position cannot contain a nucleotide of the same type as the one to be detected, or this will cause premature termination of the extension primer. Alternatively, if all four ddNTPs alone, with no dNTPs, are added to the reaction mixture, the primer will always be extended by only one nucleotide, corresponding to the target SNP position. In this instance, primers are designed to bind one nucleotide upstream from the SNP position (i.e., the nucleotide at the 3' end of the primer hybridizes to the nucleotide that is immediately adjacent to the target SNP site on the 5' side of the target SNP site). Extension by only one nucleotide is preferable, as it minimizes the overall mass of the extended primer, thereby increasing the resolution of mass differences between alternative SNP nucleotides. Furthermore, mass-tagged ddNTPs can be employed in the primer extension reactions in place of unmodified ddNTPs. This increases the mass difference between primers extended with these ddNTPs, thereby providing increased sensitivity and accuracy, and is particularly useful for typing heterozygous base positions. Mass-tagging also alleviates the need for intensive sample-preparation procedures and decreases the necessary resolving power of the mass spectrometer.

The extended primers can then be purified and analyzed by MALDI-TOF mass spectrometry to determine the identity of the nucleotide present at the target SNP position. In one method of analysis, the products from the primer extension reaction are combined with light absorbing crystals that form a matrix. The matrix is then hit with an energy source such as a laser to ionize and desorb the nucleic acid molecules into the gas-phase. The ionized molecules are then ejected into a flight tube and accelerated down the tube towards a detector. The time between the ionization event, such as a laser pulse, and collision of the molecule with the detector is the time of flight of that molecule. The time of flight is precisely correlated with the mass-to-charge ratio (m/z) of the ionized molecule. Ions with smaller m/z travel down the tube faster than ions with larger m/z and therefore the lighter ions reach the detector before the heavier ions. The time-of-flight is then converted into a corresponding, and highly precise, m/z. In this manner, SNPs can be identified based on the slight differences in mass, and the corresponding time of flight differences, inherent in nucleic acid molecules having different nucleotides at a single base position. For further information regarding the use of primer extension assays in conjunction with MALDI-TOF mass spectrometry for SNP genotyping, see, e.g., Wise et al., "A standard protocol for single nucleotide primer extension in the human genome using matrix-assisted laser desorption/ionization time-of-flight mass spectrometry," *Rapid Commun Mass Spectrom* 17(11):1195-202 (2003).

The following references provide further information describing mass spectrometry-based methods for SNP genotyping: Bocker, "SNP and mutation discovery using base-specific cleavage and MALDI-TOF mass spectrometry," *Bioinformatics* 19 Suppl 1:I44-I53 (July 2003); Storm et al., "MALDI-TOF mass spectrometry-based SNP genotyping," *Methods Mol Biol* 212:241-62 (2003); Jurinke et al., "The use of Mass ARRAY technology for high throughput genotyping," *Adv Biochem Eng Biotechnol* 77:57-74 (2002); and Jurinke et al., "Automated genotyping using the DNA MassArray technology," *Methods Mol Biol* 187:179-92 (2002).

SNPs can also be scored by direct DNA sequencing. A variety of automated sequencing procedures can be utilized (e.g. *Biotechniques* 19:448 (1995)), including sequencing by mass spectrometry. See, e.g., PCT International Publication No. WO 94/16101; Cohen et al., *Adv Chromatogr* 36:127-162 (1996); and Griffin et al., *Appl Biochem Biotechnol* 38:147-159 (1993). The nucleic acid sequences of the present invention enable one of ordinary skill in the art to readily design sequencing primers for such automated sequencing procedures. Commercial instrumentation, such as the Applied Biosystems 377, 3100, 3700, 3730, and 3730×1 DNA Analyzers (Foster City, Calif.), is commonly used in the art for automated sequencing.

Other methods that can be used to genotype the SNPs of the present invention include single-strand conformational polymorphism (SSCP), and denaturing gradient gel electrophoresis (DGGE). Myers et al., *Nature* 313:495 (1985). SSCP identifies base differences by alteration in electrophoretic migration of single stranded PCR products, as described in Orita et al., *Proc. Nat. Acad*. Single-stranded PCR products can be generated by heating or otherwise denaturing double stranded PCR products. Single-stranded nucleic acids may refold or form secondary structures that are partially dependent on the base sequence. The different electrophoretic mobilities of single-stranded amplification products are related to base-sequence differences at SNP positions. DGGE differentiates SNP alleles based on the different sequence-dependent stabilities and melting properties inherent in polymorphic DNA and the corresponding differences in electrophoretic migration patterns in a denaturing gradient gel. PCR

*Technology: Principles and Applications for DNA Amplification* Chapter 7, Erlich, ed., W.H. Freeman and Co, N.Y. (1992).

Sequence-specific ribozymes (U.S. Pat. No. 5,498,531) can also be used to score SNPs based on the development or loss of a ribozyme cleavage site. Perfectly matched sequences can be distinguished from mismatched sequences by nuclease cleavage digestion assays or by differences in melting temperature. If the SNP affects a restriction enzyme cleavage site, the SNP can be identified by alterations in restriction enzyme digestion patterns, and the corresponding changes in nucleic acid fragment lengths determined by gel electrophoresis.

SNP genotyping can include the steps of, for example, collecting a biological sample from a human subject (e.g., sample of tissues, cells, fluids, secretions, etc.), isolating nucleic acids (e.g., genomic DNA, mRNA or both) from the cells of the sample, contacting the nucleic acids with one or more primers which specifically hybridize to a region of the isolated nucleic acid containing a target SNP under conditions such that hybridization and amplification of the target nucleic acid region occurs, and determining the nucleotide present at the SNP position of interest, or, in some assays, detecting the presence or absence of an amplification product (assays can be designed so that hybridization and/or amplification will only occur if a particular SNP allele is present or absent). In some assays, the size of the amplification product is detected and compared to the length of a control sample; for example, deletions and insertions can be detected by a change in size of the amplified product compared to a normal genotype.

SNP genotyping is useful for numerous practical applications, as described below. Examples of such applications include, but are not limited to, SNP-disease association analysis, disease predisposition screening, disease diagnosis, disease prognosis, disease progression monitoring, determining therapeutic strategies based on an individual's genotype ("pharmacogenomics"), developing therapeutic agents based on SNP genotypes associated with a disease or likelihood of responding to a drug, stratifying patient populations for clinical trials of a therapeutic, preventive, or diagnostic agent, predicting the likelihood that an individual will experience toxic side effects from a therapeutic agent, and human identification applications such as forensics.

Analysis of Genetic Associations between SNPs and Phenotypic Traits

SNP genotyping for disease diagnosis, disease predisposition screening, disease prognosis, determining drug responsiveness (pharmacogenomics), drug toxicity screening, and other uses described herein, typically relies on initially establishing a genetic association between one or more specific SNPs and the particular phenotypic traits of interest.

Different study designs may be used for genetic association studies. *Modern Epidemiology* 609-622, Lippincott, Williams & Wilkins (1998). Observational studies are most frequently carried out in which the response of the patients is not interfered with. The first type of observational study identifies a sample of persons in whom the suspected cause of the disease is present and another sample of persons in whom the suspected cause is absent, and then the frequency of development of disease in the two samples is compared. These sampled populations are called cohorts, and the study is a prospective study. The other type of observational study is case-control or a retrospective study. In typical case-control studies, samples are collected from individuals with the phenotype of interest (cases) such as certain manifestations of a disease, and from individuals without the phenotype (controls) in a population (target population) that conclusions are to be drawn from. Then the possible causes of the disease are investigated retrospectively. As the time and costs of collecting samples in case-control studies are considerably less than those for prospective studies, case-control studies are the more commonly used study design in genetic association studies, at least during the exploration and discovery stage.

In both types of observational studies, there may be potential confounding factors that should be taken into consideration. Confounding factors are those that are associated with both the real cause(s) of the disease and the disease itself, and they include demographic information such as age, gender, ethnicity as well as environmental factors. When confounding factors are not matched in cases and controls in a study, and are not controlled properly, spurious association results can arise. If potential confounding factors are identified, they should be controlled for by analysis methods explained below.

In a genetic association study, the cause of interest to be tested is a certain allele or a SNP or a combination of alleles or a haplotype from several SNPs. Thus, tissue specimens (e.g., whole blood) from the sampled individuals may be collected and genomic DNA genotyped for the SNP(s) of interest. In addition to the phenotypic trait of interest, other information such as demographic (e.g., age, gender, ethnicity, etc.), clinical, and environmental information that may influence the outcome of the trait can be collected to further characterize and define the sample set. In many cases, these factors are known to be associated with diseases and/or SNP allele frequencies. There are likely gene-environment and/or gene-gene interactions as well. Analysis methods to address gene-environment and gene-gene interactions (for example, the effects of the presence of both susceptibility alleles at two different genes can be greater than the effects of the individual alleles at two genes combined) are discussed below.

After all the relevant phenotypic and genotypic information has been obtained, statistical analyses are carried out to determine if there is any significant correlation between the presence of an allele or a genotype with the phenotypic characteristics of an individual. Preferably, data inspection and cleaning are first performed before carrying out statistical tests for genetic association. Epidemiological and clinical data of the samples can be summarized by descriptive statistics with tables and graphs. Data validation is preferably performed to check for data completion, inconsistent entries, and outliers. Chi-squared tests and t-tests (Wilcoxon rank-sum tests if distributions are not normal) may then be used to check for significant differences between cases and controls for discrete and continuous variables, respectively. To ensure genotyping quality, Hardy-Weinberg disequilibrium tests can be performed on cases and controls separately. Significant deviation from Hardy-Weinberg equilibrium (HWE) in both cases and controls for individual markers can be indicative of genotyping errors. If HWE is violated in a majority of markers, it is indicative of population substructure that should be further investigated. Moreover, Hardy-Weinberg disequilibrium in cases only can indicate genetic association of the markers with the disease. B. Weir, *Genetic Data Analysis*, Sinauer (1990).

To test whether an allele of a single SNP is associated with the case or control status of a phenotypic trait, one skilled in the art can compare allele frequencies in cases and controls. Standard chi-squared tests and Fisher exact tests can be carried out on a 2×2 table (2 SNP alleles×2 outcomes in the categorical trait of interest). To test whether genotypes of a SNP are associated, chi-squared tests can be carried out on a 3×2 table (3 genotypes×2 outcomes). Score tests are also carried out for genotypic association to contrast the three genotypic frequencies (major homozygotes, heterozygotes and minor homozygotes) in cases and controls, and to look for trends using 3 different modes of inheritance, namely dominant (with contrast coefficients 2, −1, −1), additive or allelic (with contrast coefficients 1, 0, −1) and recessive (with contrast coefficients 1, 1, −2). Odds ratios for minor versus major alleles, and odds ratios for heterozygote and homozygote variants versus the wild type genotypes are calculated with the desired confidence limits, usually 95%.

In order to control for cofounders and to test for interaction and effect modifiers, stratified analyses may be performed using stratified factors that are likely to be confounding, including demographic information such as age, ethnicity, and gender, or an interacting element or effect modifier, such as a known major gene (e.g., APOE for Alzheimer's disease or HLA genes for autoimmune diseases), or environmental factors such as smoking in lung cancer. Stratified association tests may be carried out using Cochran-Mantel-Haenszel tests that take into account the ordinal nature of genotypes with 0, 1, and 2 variant alleles. Exact tests by StatXact may also be performed when computationally possible. Another way to adjust for confounding effects and test for interactions is to perform stepwise multiple logistic regression analysis using statistical packages such as SAS or R. Logistic regression is a model-building technique in which the best fitting and most parsimonious model is built to describe the relation between the dichotomous outcome (for instance, getting a certain disease or not) and a set of independent variables (for instance, genotypes of different associated genes, and the associated demographic and environmental factors). The most common model is one in which the logit transformation of the odds ratios is expressed as a linear combination of the variables (main effects) and their cross-product terms (interactions). Hosmer and Lemeshow, *Applied Logistic Regression*, Wiley (2000). To test whether a certain variable or interaction is significantly associated with the outcome, coefficients in the model are first estimated and then tested for statistical significance of their departure from zero.

In addition to performing association tests one marker at a time, haplotype association analysis may also be performed to study a number of markers that are closely linked together. Haplotype association tests can have better power than genotypic or allelic association tests when the tested markers are not the disease-causing mutations themselves but are in linkage disequilibrium with such mutations. The test will even be more powerful if the disease is indeed caused by a combination of alleles on a haplotype (e.g., APOE is a haplotype formed by 2 SNPs that are very close to each other). In order to perform haplotype association effectively, marker-marker linkage disequilibrium measures, both D' and $r^2$, are typically calculated for the markers within a gene to elucidate the haplotype structure. Recent studies in linkage disequilibrium indicate that SNPs within a gene are organized in block pattern, and a high degree of linkage disequilibrium exists within blocks and very little linkage disequilibrium exists between blocks. Daly et al, *Nature Genetics* 29:232-235 (2001). Haplotype association with the disease status can be performed using such blocks once they have been elucidated.

Haplotype association tests can be carried out in a similar fashion as the allelic and genotypic association tests. Each haplotype in a gene is analogous to an allele in a multi-allelic marker. One skilled in the art can either compare the haplotype frequencies in cases and controls or test genetic association with different pairs of haplotypes. It has been proposed that score tests can be done on haplotypes using the program "haplo.score." Schaid et al, *Am J Hum Genet.* 70:425-434 (2002). In that method, haplotypes are first inferred by EM algorithm and score tests are carried out with a generalized linear model (GLM) framework that allows the adjustment of other factors.

An important decision in the performance of genetic association tests is the determination of the significance level at which significant association can be declared when the P value of the tests reaches that level. In an exploratory analysis where positive hits will be followed up in subsequent confirmatory testing, an unadjusted P value <0.2 (a significance level on the lenient side), for example, may be used for generating hypotheses for significant association of a SNP with certain phenotypic characteristics of a disease. It is preferred that a p-value <0.05 (a significance level traditionally used in the art) is achieved in order for a SNP to be considered to have an association with a disease. It is more preferred that a p-value <0.01 (a significance level on the stringent side) is achieved for an association to be declared. When hits are followed up in confirmatory analyses in more samples of the same source or in different samples from different sources, adjustment for multiple testing will be performed as to avoid excess number of hits while maintaining the experiment-wide error rates at 0.05. While there are different methods to adjust for multiple testing to control for different kinds of error rates, a commonly used but rather conservative method is Bonferroni correction to control the experiment-wise or family-wise error rate. Westfall et al., *Multiple comparisons and multiple tests*, SAS Institute (1999). Permutation tests to control for the false discovery rates, FDR, can be more powerful. Benjamini and Hochberg, *Journal of the Royal Statistical Society*, Series B 57:1289-1300 (1995); Westfall and Young, *Resampling-based Multiple Testing*, Wiley (1993). Such methods to control for multiplicity would be preferred when the tests are dependent and controlling for false discovery rates is sufficient as opposed to controlling for the experiment-wise error rates.

In replication studies using samples from different populations after statistically significant markers have been identified in the exploratory stage, meta-analyses can then be performed by combining evidence of different studies. *Modern Epidemiology* 643-673, Lippincott, Williams & Wilkins (1998). If available, association results known in the art for the same SNPs can be included in the meta-analyses.

Since both genotyping and disease status classification can involve errors, sensitivity analyses may be performed to see how odds ratios and p-values would change upon various estimates on genotyping and disease classification error rates.

It has been well known that subpopulation-based sampling bias between cases and controls can lead to spurious results in case-control association studies when prevalence of the disease is associated with different subpopulation groups. Ewens and Spielman, *Am J Hum Genet.* 62:450-458 (1995). Such bias can also lead to a loss of statistical power in genetic association studies. To detect population stratification, Pritchard and Rosenberg suggested typing markers that are unlinked to the disease and using results of association tests on those markers to determine whether there is any population stratification. Pritchard et al., *Am J Hum Gen* 65:220-228 (1999). When stratification is detected, the genomic control (GC) method as proposed by Devlin and Roeder can be used to adjust for the inflation of test statistics due to population stratification. Devlin et al., *Biometrics* 55:997-1004 (1999). The GC method is robust to changes in population structure levels as well as being applicable to DNA pooling designs. Devlin et al., *Genet Epidem* 21:273-284 (2001).

While Pritchard's method recommended using 15-20 unlinked microsatellite markers, it suggested using more than 30 biallelic markers to get enough power to detect population stratification. For the GC method, it has been shown that about 60-70 biallelic markers are sufficient to estimate the inflation factor for the test statistics due to population stratification. Bacanu et al., *Am J Hum Genet.* 66:1933-1944 (2000). Hence, 70 intergenic SNPs can be chosen in unlinked regions as indicated in a genome scan. Kehoe et al., *Hum Mol Genet.* 8:237-245 (1999).

Once individual risk factors, genetic or non-genetic, have been found for the predisposition to disease, the next step is to set up a classification/prediction scheme to predict the category (for instance, disease or no-disease) that an individual will be in depending on his genotypes of associated SNPs and other non-genetic risk factors. Logistic regression for discrete trait and linear regression for continuous trait are standard techniques for such tasks. Draper and Smith, *Applied Regression Analysis*, Wiley (1998). Moreover, other techniques can also be used for setting up classification. Such techniques include, but are not limited to, MART, CART, neural network, and discriminant analyses that are suitable for use in comparing the performance of different methods. *The Elements of Statistical Learning*, Hastie, Tibshirani & Friedman, Springer (2002).

Disease Diagnosis and Predisposition Screening

Information on association/correlation between genotypes and disease-related phenotypes can be exploited in several ways. For example, in the case of a highly statistically significant association between one or more SNPs with predisposition to a disease for which treatment is available, detection of such a genotype pattern in an individual may justify immediate administration of treatment, or at least the institution of regular monitoring of the individual. Detection of the susceptibility alleles associated with serious disease in a couple contemplating having children may also be valuable to the couple in their reproductive decisions. In the case of a weaker but still statistically significant association between a SNP and a human disease, immediate therapeutic intervention or monitoring may not be justified after detecting the susceptibility allele or SNP. Nevertheless, the subject can be motivated to begin simple life-style changes (e.g., diet, exercise) that can be accomplished at little or no cost to the individual but would confer potential benefits in reducing the risk of developing conditions for which that individual may have an increased risk by virtue of having the risk allele(s).

The SNPs of the invention may contribute to the development of autoimmune disease (e.g., RA), or to responsiveness of an individual to TNF inhibitor treatment, in different ways. Some polymorphisms occur within a protein coding sequence and contribute to disease phenotype by affecting protein structure. Other polymorphisms occur in noncoding regions but may exert phenotypic effects indirectly via influence on, for example, replication, transcription, and/or translation. A single SNP may affect more than one phenotypic trait. Likewise, a single phenotypic trait may be affected by multiple SNPs in different genes.

As used herein, the terms "diagnose," "diagnosis," and "diagnostics" include, but are not limited to, any of the following: detection of autoimmune disease (such as RA) that an individual may presently have, predisposition/susceptibility/predictive screening (i.e., determining whether an individual has an increased or decreased risk of developing autoimmune disease in the future), prognosing the future course of autoimmune disease or recurrence of autoimmune disease in an individual, determining a particular type or subclass of autoimmune disease in an individual who currently or previously had autoimmune disease, confirming or reinforcing a previously made diagnosis of autoimmune disease, evaluating an individual's likelihood of responding positively to a particular treatment or therapeutic agent such as TNF inhibitor treatment (particularly treatment or prevention of autoimmune disease using TNF inhibitors), determining or selecting a therapeutic or preventive strategy that an individual is most likely to positively respond to (e.g., selecting a particular therapeutic agent such as a TNF inhibitor, or combination of therapeutic agents, or determining a dosing regimen, etc.), classifying (or confirming/reinforcing) an individual as a responder/non-responder (or determining a particular subtype of responder/non-responder) with respect to the individual's response to a drug treatment such as TNF inhibitor treatment, and predicting whether a patient is likely to experience toxic effects from a particular treatment or therapeutic compound. Such diagnostic uses can be based on the SNPs individually or in a unique combination or SNP haplotypes of the present invention.

Haplotypes are particularly useful in that, for example, fewer SNPs can be genotyped to determine if a particular genomic region harbors a locus that influences a particular phenotype, such as in linkage disequilibrium-based SNP association analysis.

Linkage disequilibrium (LD) refers to the co-inheritance of alleles (e.g., alternative nucleotides) at two or more different SNP sites at frequencies greater than would be expected from the separate frequencies of occurrence of each allele in a given population. The expected frequency of co-occurrence of two alleles that are inherited independently is the frequency of the first allele multiplied by the frequency of the second allele. Alleles that co-occur at expected frequencies are said to be in "linkage equilibrium." In contrast, LD refers to any non-random genetic association between allele(s) at two or more different SNP sites, which is generally due to the physical proximity of the two loci along a chromosome. LD can occur when two or more SNPs sites are in close physical proximity to each other on a given chromosome and therefore alleles at these SNP sites will tend to remain unseparated for multiple generations with the consequence that a particular nucleotide (allele) at one SNP site will show a non-random association with a particular nucleotide (allele) at a different SNP site located nearby. Hence, genotyping one of the SNP sites will give almost the same information as genotyping the other SNP site that is in LD.

Various degrees of LD can be encountered between two or more SNPs with the result being that some SNPs are more closely associated (i.e., in stronger LD) than others. Furthermore, the physical distance over which LD extends along a chromosome differs between different regions of the genome, and therefore the degree of physical separation between two or more SNP sites necessary for LD to occur can differ between different regions of the genome.

For diagnostic purposes and similar uses, if a particular SNP site is found to be useful for, for example, predicting an individual's susceptibility to autoimmune disease or an individual's response to TNF inhibitor treatment, then the skilled artisan would recognize that other SNP sites which are in LD with this SNP site would also be useful for the same purposes. Thus, polymorphisms (e.g., SNPs and/or haplotypes) that are not the actual disease-causing (causative) polymorphisms, but are in LD with such causative polymorphisms, are also useful. In such instances, the genotype of the polymorphism(s) that is/are in LD with the causative polymorphism is predictive of the genotype of the causative polymorphism and, consequently, predictive of the phenotype (e.g., autoimmune disease, or responder/non-responder to a drug treatment) that is influenced by the causative SNP(s). Therefore, polymorphic markers that are in LD with causative polymorphisms are useful as diagnostic markers, and are particularly useful when the actual causative polymorphism(s) is/are unknown.

Examples of polymorphisms that can be in LD with one or more causative polymorphisms (and/or in LD with one or more polymorphisms that have a significant statistical association with a condition) and therefore useful for diagnosing the same condition that the causative/associated SNP(s) is used to diagnose, include other SNPs in the same gene, protein-coding, or mRNA transcript-coding region as the causative/associated SNP, other SNPs in the same exon or same intron as the causative/associated SNP, other SNPs in the same haplotype block as the causative/associated SNP, other SNPs in the same intergenic region as the causative/associated SNP, SNPs that are outside but near a gene (e.g., within 6 kb on either side, 5' or 3', of a gene boundary) that harbors a causative/associated SNP, etc. Such useful LD SNPs can be selected from among the SNPs disclosed in Tables 1 and 2, for example.

Linkage disequilibrium in the human genome is reviewed in Wall et al., "Haplotype blocks and linkage disequilibrium in the human genome," *Nat Rev Genet.* 4(8):587-97 (August 2003); Garner et al., "On selecting markers for association studies: patterns of linkage disequilibrium between two and three diallelic loci," *Genet Epidemiol* 24(1):57-67 (January 2003); Ardlie et al., "Patterns of linkage disequilibrium in the human genome," *Nat Rev Genet.* 3(4):299-309 (April 2002); erratum in *Nat Rev Genet.* 3(7):566 (July 2002); and Remm et al., "High-density genotyping and linkage disequilibrium in the human genome using chromosome 22 as a model," *Curr Opin Chem Biol* 6(1):24-30 (February 2002); J. B. S. Haldane, "The combination of linkage values, and the calculation of distances between the loci of linked factors," *J Genet.* 8:299-309 (1919); G. Mendel, *Versuche über Pflanzen-Hybriden. Verhandlungen des naturforschenden Vereines in Brünn* (*Proceedings of the Natural History Society of Brünn*) (1866); *Genes IV*, B. Lewin, ed., Oxford University Press, N.Y. (1990); D. L. Hartl and A. G. Clark *Principles of Population Genetics* 2$^{nd}$ ed., Sinauer Associates, Inc., Mass. (1989); J. H. Gillespie *Population Genetics: A Concise Guide.* 2$^{nd}$ ed., Johns Hopkins University Press (2004); R. C. Lewontin, "The interaction of selection and linkage. I. General considerations; heterotic models," *Genetics* 49:49-67 (1964); P. G. Hoel, *Introduction to Mathematical Statistics* 2$^{nd}$ ed., John Wiley & Sons, Inc., N.Y. (1954); R. R. Hudson, "Two-locus sampling distributions and their application," *Genetics* 159:1805-1817 (2001); A. P. Dempster, N. M. Laird, D. B. Rubin, "Maximum likelihood from incomplete data via the EM algorithm," *J R Stat Soc* 39:1-38 (1977); L. Excoffier, M. Slatkin, "Maximum-likelihood estimation of molecular haplotype frequencies in a diploid population," *Mol Biol Evol* 12(5):921-927 (1995); D. A. Tregouet, S. Escolano, L. Tiret, A. Mallet, J. L. Golmard, "A new algorithm for haplotype-based association analysis: the Stochastic-EM algorithm," *Ann Hum Genet.* 68(Pt 2):165-177 (2004); A. D. Long and C. H. Langley C H, "The power of association studies to detect the contribution of candidate genetic loci to variation in complex traits," *Genome Research* 9:720-731 (1999); A. Agresti, *Categorical Data Analysis*, John Wiley & Sons, Inc., N.Y. (1990); K. Lange, *Mathematical and Statistical Methods for Genetic Analysis*, Springer-Verlag New York, Inc., N.Y. (1997); The International HapMap Consortium, "The International HapMap Project," *Nature* 426:789-796 (2003); The International HapMap Consortium, "A haplotype map of the human genome," *Nature* 437:1299-1320 (2005); G. A. Thorisson, A. V. Smith, L. Krishnan, L. D. Stein, "The International HapMap Project Web Site," *Genome Research* 15:1591-1593 (2005); G. McVean, C. C. A. Spencer, R. Chaix, "Perspectives on human genetic variation from the HapMap project," *PLoS Genetics* 1(4):413-418 (2005); J. N. Hirschhorn, M. J. Daly, "Genome-wide association studies for common diseases and complex traits," *Nat Genet.* 6:95-108 (2005); S. J. Schrodi, "A probabilistic approach to large-scale association scans: a semi-Bayesian method to detect disease-predisposing alleles," *SAGMB* 4(1):31 (2005); W. Y. S. Wang, B. J. Barratt, D. G. Clayton, J. A. Todd, "Genome-wide association studies: theoretical and practical concerns," *Nat Rev Genet.* 6:109-118 (2005); J. K. Pritchard, M. Przeworski, "Linkage disequilibrium in humans: models and data," *Am J Hum Genet.* 69:1-14 (2001).

As discussed above, one aspect of the present invention is the discovery that SNPs that are in certain LD distance with an interrogated SNP can also be used as valid markers for determining whether an individual has an increased or decreased risk of having or developing autoimmune disease, or an individual's likelihood of benefiting from a drug treatment such as TNF inhibitor treatment. As used herein, the term "interrogated SNP" refers to SNPs that have been found to be associated with an increased or decreased risk of disease using genotyping results and analysis, or other appropriate experimental method as exemplified in the working examples described in this application. As used herein, the term "LD SNP" refers to a SNP that has been characterized as a SNP associating with an increased or decreased risk of diseases due to their being in LD with the "interrogated SNP" under the methods of calculation described in the application. Below, applicants describe the methods of calculation with which one of ordinary skilled in the art may determine if a particular SNP is in LD with an interrogated SNP. The parameter $r^2$ is commonly used in the genetics art to characterize the extent of linkage disequilibrium between markers (Hudson, 2001). As used herein, the term "in LD with" refers to a particular SNP that is measured at above the threshold of a parameter such as $r^2$ with an interrogated SNP.

It is now common place to directly observe genetic variants in a sample of chromosomes obtained from a population. Suppose one has genotype data at two genetic markers located on the same chromosome, for the markers A and B. Further suppose that two alleles segregate at each of these two markers such that alleles $A_1$ and $A_2$ can be found at marker A and alleles $B_1$ and $B_2$ at marker B. Also assume that these two markers are on a human autosome. If one is to examine a specific individual and find that they are heterozygous at both markers, such that their two-marker genotype is $A_1A_2B_1B_2$, then there are two possible configurations: the individual in question could have the alleles $A_1B_1$ on one chromosome and $A_2B_2$ on the remaining chromosome; alternatively, the individual could have alleles $A_1B_2$ on one chromosome and $A_2B_1$ on the other. The arrangement of alleles on a chromosome is called a haplotype. In this illustration, the individual could have haplotypes $A_1B_1/A_2B_2$ or $A_1B_2/A_2B_1$ (see Hartl and Clark (1989) for a more complete description). The concept of linkage equilibrium relates the frequency of haplotypes to the allele frequencies.

Assume that a sample of individuals is selected from a larger population. Considering the two markers described above, each having two alleles, there are four possible haplotypes: $A_1B_1, A_1B_2, A_2B_1$ and $A_2B_2$. Denote the frequencies of these four haplotypes with the following notation.

$$P_{11} = \text{freq}(A_1B_1) \tag{1}$$

$$P_{12} = \text{freq}(A_1B_2) \tag{2}$$

$$P_{21} = \text{freq}(A_2B_1) \tag{3}$$

$$P_{22} = \text{freq}(A_2B_2) \tag{4}$$

The allele frequencies at the two markers are then the sum of different haplotype frequencies, it is straightforward to write down a similar set of equations relating single-marker allele frequencies to two-marker haplotype frequencies:

$$p_1 = \text{freq}(A_1) = P_{11} + P_{12} \qquad (5)$$

$$p_2 = \text{freq}(A_2) = P_{21} + P_{22} \qquad (6)$$

$$q_1 = \text{freq}(B_1) = P_{11} + P_{21} \qquad (7)$$

$$q_2 = \text{freq}(B_2) = P_{12} + P_{22} \qquad (8)$$

Note that the four haplotype frequencies and the allele frequencies at each marker must sum to a frequency of 1.

$$P_{11} + P_{12} + P_{21} + P_{22} = 1 \qquad (9)$$

$$p_1 + p_2 = 1 \qquad (10)$$

$$q_1 + q_2 = 1 \qquad (11)$$

If there is no correlation between the alleles at the two markers, one would expect that the frequency of the haplotypes would be approximately the product of the composite alleles. Therefore, $$P_{11} \approx p_1 q_1 \qquad (12)$$

$$P_{12} \approx p_1 q_2 \qquad (13)$$

$$P_{21} \approx p_2 q_1 \qquad (14)$$

$$P_{22} \approx p_2 q_2 \qquad (15)$$

These approximating equations (12)-(15) represent the concept of linkage equilibrium where there is independent assortment between the two markers—the alleles at the two markers occur together at random. These are represented as approximations because linkage equilibrium and linkage disequilibrium are concepts typically thought of as properties of a sample of chromosomes; and as such they are susceptible to stochastic fluctuations due to the sampling process. Empirically, many pairs of genetic markers will be in linkage equilibrium, but certainly not all pairs.

Having established the concept of linkage equilibrium above, applicants can now describe the concept of linkage disequilibrium (LD), which is the deviation from linkage equilibrium. Since the frequency of the $A_1B_1$ haplotype is approximately the product of the allele frequencies for $A_1$ and $B_1$ under the assumption of linkage equilibrium as stated mathematically in (12), a simple measure for the amount of departure from linkage equilibrium is the difference in these two quantities, D, $$D = P_{11} - p_1 q_1 \qquad (16)$$

D=0 indicates perfect linkage equilibrium. Substantial departures from D=0 indicates LD in the sample of chromosomes examined. Many properties of D are discussed in Lewontin (1964) including the maximum and minimum values that D can take. Mathematically, using basic algebra, it can be shown that D can also be written solely in terms of haplotypes:

$$D = P_{11}P_{22} - P_{12}P_{21} \qquad (17)$$

If one transforms D by squaring it and subsequently dividing by the product of the allele frequencies of $A_1$, $A_2$, $B_1$ and $B_2$, the resulting quantity, called $r^2$, is equivalent to the square of the Pearson's correlation coefficient commonly used in statistics (e.g., Hoel, 1954).

$$r^2 = \frac{D^2}{p_1 p_2 q_1 q_2} \qquad (18)$$

As with D, values of $r^2$ close to 0 indicate linkage equilibrium between the two markers examined in the sample set. As values of $r^2$ increase, the two markers are said to be in linkage disequilibrium. The range of values that $r^2$ can take are from 0 to 1. $r^2=1$ when there is a perfect correlation between the alleles at the two markers.

In addition, the quantities discussed above are sample-specific. And as such, it is necessary to formulate notation specific to the samples studied. In the approach discussed here, three types of samples are of primary interest: (i) a sample of chromosomes from individuals affected by a disease-related phenotype (cases), (ii) a sample of chromosomes obtained from individuals not affected by the disease-related phenotype (controls), and (iii) a standard sample set used for the construction of haplotypes and calculation pairwise linkage disequilibrium. For the allele frequencies used in the development of the method described below, an additional subscript will be added to denote either the case or control sample sets.

$$p_{1,cs} = \text{freq}(A_1 \text{ in cases}) \qquad (19)$$

$$p_{2,cs} = \text{freq}(A_2 \text{ in cases}) \qquad (20)$$

$$q_{1,cs} = \text{freq}(B_1 \text{ in cases}) \qquad (21)$$

$$q_{2,cs} = \text{freq}(B_1 \text{ in cases}) \qquad (22)$$

Similarly, $$p_{1,ct} = \text{freq}(A_1 \text{ in controls}) \qquad (23)$$

$$p_{2,ct} = \text{freq}(A_2 \text{ in controls}) \qquad (24)$$

$$q_{1,ct} = \text{freq}(B_1 \text{ in controls}) \qquad (25)$$

$$q_{2,ct} = \text{freq}(B_2 \text{ in controls}) \qquad (26)$$

As a well-accepted sample set is necessary for robust linkage disequilibrium calculations, data obtained from the International HapMap project (The International HapMap Consortium 2003, 2005; Thorisson et al, 2005; McVean et al, 2005) can be used for the calculation of pairwise $r^2$ values. Indeed, the samples genotyped for the International HapMap Project were selected to be representative examples from various human sub-populations with sufficient numbers of chromosomes examined to draw meaningful and robust conclusions from the patterns of genetic variation observed. The International HapMap project website (hapmap.org) contains a description of the project, methods utilized and samples examined. It is useful to examine empirical data to get a sense of the patterns present in such data.

Haplotype frequencies were explicit arguments in equation (18) above. However, knowing the 2-marker haplotype frequencies requires that phase to be determined for doubly heterozygous samples. When phase is unknown in the data examined, various algorithms can be used to infer phase from the genotype data. This issue was discussed earlier where the doubly heterozygous individual with a 2-SNP genotype of $A_1A_2B_1B_2$ could have one of two different sets of chromosomes: $A_1B_1/A_2B_2$ or $A_1B_2/A_2B_1$. One such algorithm to estimate haplotype frequencies is the expectation-maximization (EM) algorithm first formalized by Dempster et al. (1977). This algorithm is often used in genetics to infer haplotype frequencies from genotype data (e.g. Excoffier and Slatkin (1995); Tregouet et al. (2004)). It should be noted that for the two-SNP case explored here, EM algorithms have very little error provided that the allele frequencies and sample sizes are not too small. The impact on $r^2$ values is typically negligible.

As correlated genetic markers share information, interrogation of SNP markers in LD with a disease-associated SNP marker can also have sufficient power to detect disease association (Long and Langley (1999)). The relationship between the power to directly find disease-associated alleles and the power to indirectly detect disease-association was investigated by Pritchard and Przeworski (2001). In a straight-forward derivation, it can be shown that the power to detect disease association indirectly at a marker locus in linkage disequilibrium with a disease-association locus is approximately the same as the power to detect disease-association directly at the disease-association locus if the sample size is increased by a factor of $$\frac{1}{r^2}$$

(the reciprocal of equation 18) at the marker in comparison with the disease-association locus.

Therefore, if one calculated the power to detect disease-association indirectly with an experiment having N samples, then equivalent power to directly detect disease-association (at the actual disease-susceptibility locus) would necessitate an experiment using approximately $r^2N$ samples. This elementary relationship between power, sample size and linkage disequilibrium can be used to derive an $r^2$ threshold value useful in determining whether or not genotyping markers in linkage disequilibrium with a SNP marker directly associated with disease status has enough power to indirectly detect disease-association.

To commence a derivation of the power to detect disease-associated markers through an indirect process, define the effective chromosomal sample size as $$n = \frac{4 N_{cs} N_{ct}}{N_{cs} + C_{ct}}; \quad (27)$$

where $N_{cs}$ and $N_{ct}$ are the numbers of diploid cases and controls, respectively. This is necessary to handle situations where the numbers of cases and controls are not equivalent. For equal case and control sample sizes, $N_{cs}=N_{ct}=N$, the value of the effective number of chromosomes is simply n=2N—as expected. Let power be calculated for a significance level a (such that traditional P-values below α will be deemed statistically significant). Define the standard Gaussian distribution function as $\Phi(\cdot)$. Mathematically, $$\Phi(x) = \frac{1}{\sqrt{2\pi}} \int_{-\infty}^{x} e^{-\frac{\theta^2}{2}} d\theta \quad (28)$$

Alternatively, the following error function notation (Erf) may also be used, $$\Phi(x) = \frac{1}{2}\left[1 + \text{Erf}\left(\frac{x}{\sqrt{2}}\right)\right] \quad (29)$$

For example, $\Phi(1.644854)=0.95$. The value of $r^2$ may be derived to yield a pre-specified minimum amount of power to detect disease association though indirect interrogation. Noting that the LD SNP marker could be the one that is carrying the disease-association allele, therefore that this approach constitutes a lower-bound model where all indirect power results are expected to be at least as large as those interrogated.

Denote by β the error rate for not detecting truly disease-associated markers. Therefore, 1-β is the classical definition of statistical power. Substituting the Pritchard-Pzreworski result into the sample size, the power to detect disease association at a significance level of α is given by the approximation $$1 - \beta \cong \Phi\left[\frac{|q_{1,cs} - q_{1,ct}|}{\sqrt{\frac{q_{1,cs}(1-q_{1,cs}) + q_{1,ct}(1-q_{1,ct})}{r^2 n}}} - Z_{1-\alpha/2}\right]; \quad (30)$$

where $Z_u$ is the inverse of the standard normal cumulative distribution evaluated at u (u∈(0,1)). $Z_u=\Phi^{-1}(u)$, where $\Phi(\Phi^{-1}(u))=\Phi^{-1}(\Phi)(u))=u$. For example, setting α=0.05, and therefore 1-α/2=0.975, one obtains $Z_{0.975}=1.95996$. Next, setting power equal to a threshold of a minimum power of T, $$T = \Phi\left[\frac{|q_{1,cs} - q_{1,ct}|}{\sqrt{\frac{q_{1,cs}(1-q_{1,cs}) + q_{1,ct}(1-q_{1,ct})}{r^2 n}}} - Z_{1-\alpha/2}\right] \quad (31)$$

and solving for $r^2$, the following threshold $r^2$ is obtained:

$$r_T^2 = \frac{[q_{1,cs}(1-q_{1,cs}) + q_{1,ct}(1-q_{1,ct})]}{n(q_{1,cs}-q_{1,ct})^2}[\Phi^{-1}(T)+Z_{1-\alpha/2}]^2 \quad (32)$$

Or, $$r_T^2 = \frac{(Z_T + Z_{1-\alpha/2})^2}{n}\left[\frac{q_{1,cs}-(q_{1,cs})^2+q_{1,ct}-(q_{1,ct})^2}{(q_{1,cs}-q_{1,ct})^2}\right] \quad (33)$$

Suppose that $r^2$ is calculated between an interrogated SNP and a number of other SNPs with varying levels of LD with the interrogated SNP. The threshold value $r_T^2$, is the minimum value of linkage disequilibrium between the interrogated SNP and the potential LD SNPs such that the LD SNP still retains a power greater or equal to T for detecting disease-association. For example, suppose that SNP rs200 is genotyped in a case-control disease-association study and it is found to be associated with a disease phenotype. Further suppose that the minor allele frequency in 1,000 case chromosomes was found to be 16% in contrast with a minor allele frequency of 10% in 1,000 control chromosomes. Given those measurements one could have predicted, prior to the experiment, that the power to detect disease association at a significance level of 0.05 was quite high—approximately 98% using a test of allelic association. Applying equation (32) one can calculate a minimum value of $r^2$ to indirectly assess disease association assuming that the minor allele at SNP rs200 is truly disease-predisposing for a threshold level of power. If one sets the threshold level of power to be 80%, then $r_T^2=0.489$ given the same significance level and chromosome numbers as above. Hence, any SNP with a pairwise $r^2$ value with rs200 greater than 0.489 is expected to have greater than 80% power to detect the disease association. Further, this is assuming the conservative model where the LD SNP is disease-associated only through linkage disequilibrium with the interrogated SNP rs200.

The contribution or association of particular SNPs and/or SNP haplotypes with disease phenotypes, such as autoimmune disease, enables the SNPs of the present invention to be used to develop superior diagnostic tests capable of identifying individuals who express a detectable trait, such as autoimmune disease, as the result of a specific genotype, or individuals whose genotype places them at an increased or decreased risk of developing a detectable trait at a subsequent time as compared to individuals who do not have that genotype. As described herein, diagnostics may be based on a single SNP or a group of SNPs. Combined detection of a plurality of SNPs (for example, 2, 3, 4, 5, 6, 7, 8, 9, 10, 11, 12, 13, 14, 15, 16, 17, 18, 19, 20, 24, 25, 30, 32, 48, 50, 64, 96, 100, or any other number in-between, or more, of the SNPs provided in Table 1 and/or Table 2) typically increases the probability of an accurate diagnosis. For example, the presence of a single SNP known to correlate with autoimmune disease might indicate a probability of 20% that an individual has or is at risk of developing autoimmune disease, whereas detection of five SNPs, each of which correlates with autoimmune disease, might indicate a probability of 80% that an individual has or is at risk of developing autoimmune disease. To further increase the accuracy of diagnosis or predisposition screening, analysis of the SNPs of the present invention can be combined with that of other polymorphisms or other risk factors of autoimmune disease, such as disease symptoms, pathological characteristics, family history, diet, environmental factors or lifestyle factors.

It will be understood by practitioners skilled in the treatment or diagnosis of autoimmune disease that the present invention generally does not intend to provide an absolute identification of individuals who are at risk (or less at risk) of developing autoimmune disease, and/or pathologies related to autoimmune disease, but rather to indicate a certain increased (or decreased) degree or likelihood of developing the disease based on statistically significant association results. However, this information is extremely valuable as it can be used to, for example, initiate preventive treatments or to allow an individual carrying one or more significant SNPs or SNP haplotypes to foresee warning signs such as minor clinical symptoms, or to have regularly scheduled physical exams to monitor for appearance of a condition in order to identify and begin treatment of the condition at an early stage. Particularly with diseases that are extremely debilitating or fatal if not treated on time, the knowledge of a potential predisposition, even if this predisposition is not absolute, would likely contribute in a very significant manner to treatment efficacy.

The diagnostic techniques of the present invention may employ a variety of methodologies to determine whether a test subject has a SNP or a SNP pattern associated with an increased or decreased risk of developing a detectable trait or whether the individual suffers from a detectable trait as a result of a particular polymorphism/mutation, including, for example, methods which enable the analysis of individual chromosomes for haplotyping, family studies, single sperm DNA analysis, or somatic hybrids. The trait analyzed using the diagnostics of the invention may be any detectable trait that is commonly observed in pathologies and disorders related to autoimmune disease.

Another aspect of the present invention relates to a method of determining whether an individual is at risk (or less at risk) of developing one or more traits or whether an individual expresses one or more traits as a consequence of possessing a particular trait-causing or trait-influencing allele. These methods generally involve obtaining a nucleic acid sample from an individual and assaying the nucleic acid sample to determine which nucleotide(s) is/are present at one or more SNP positions, wherein the assayed nucleotide(s) is/are indicative of an increased or decreased risk of developing the trait or indicative that the individual expresses the trait as a result of possessing a particular trait-causing or trait-influencing allele.

In another embodiment, the SNP detection reagents of the present invention are used to determine whether an individual has one or more SNP allele(s) affecting the level (e.g., the concentration of mRNA or protein in a sample, etc.) or pattern (e.g., the kinetics of expression, rate of decomposition, stability profile, Km, Vmax, etc.) of gene expression (collectively, the "gene response" of a cell or bodily fluid). Such a determination can be accomplished by screening for mRNA or protein expression (e.g., by using nucleic acid arrays, RT-PCR, TaqMan assays, or mass spectrometry), identifying genes having altered expression in an individual, genotyping SNPs disclosed in Table 1 and/or Table 2 that could affect the expression of the genes having altered expression (e.g., SNPs that are in and/or around the gene(s) having altered expression, SNPs in regulatory/control regions, SNPs in and/or around other genes that are involved in pathways that could affect the expression of the gene(s) having altered expression, or all SNPs could be genotyped), and correlating SNP genotypes with altered gene expression. In this manner, specific SNP alleles at particular SNP sites can be identified that affect gene expression.

Therapeutics, Pharmacogenomics, and Drug Development
Therapeutic Methods and Compositions In certain aspects of the invention, there are provided methods of assaying (i.e., testing) one or more SNPs provided by the present invention in an individual's nucleic acids, and administering a therapeutic or preventive agent to the individual based on the allele(s) present at the SNP(s) having indicated that the individual can benefit from the therapeutic or preventive agent.

In further aspects of the invention, there are provided methods of assaying one or more SNPs provided by the present invention in an individual's nucleic acids, and administering a diagnostic agent (e.g., an imaging agent), or otherwise carrying out further diagnostic procedures on the individual, based on the allele(s) present at the SNP(s) having indicated that the diagnostic agents or diagnostics procedures are justified in the individual.

In yet other aspects of the invention, there is provided a pharmaceutical pack comprising a therapeutic agent (e.g., a small molecule drug, antibody, peptide, antisense or RNAi nucleic acid molecule, etc.) and a set of instructions for administration of the therapeutic agent to an individual who has been tested for one or more SNPs provided by the present invention.

Pharmacogenomics

The present invention provides methods for assessing the pharmacogenomics of a subject harboring particular SNP alleles or haplotypes to a particular therapeutic agent or pharmaceutical compound, or to a class of such compounds. Pharmacogenomics deals with the roles which clinically significant hereditary variations (e.g., SNPs) play in the response to drugs due to altered drug disposition and/or abnormal action in affected persons. See, e.g., Roses, *Nature* 405, 857-865 (2000); Gould Rothberg, *Nature Biotechnology* 19, 209-211 (2001); Eichelbaum, *Clin Exp Pharmacol Physiol* 23(10-11): 983-985 (1996); and Linder, *Clin Chem* 43(2):254-266 (1997). The clinical outcomes of these variations can result in severe toxicity of therapeutic drugs in certain individuals or therapeutic failure of drugs in certain individuals as a result of individual variation in metabolism. Thus, the SNP genotype of an individual can determine the way a therapeutic compound acts on the body or the way the body metabolizes the compound. For example, SNPs in drug-metabolizing enzymes can affect the activity of these enzymes, which in turn can affect both the intensity and duration of drug action, as well as drug metabolism and clearance.

The discovery of SNPs in drug-metabolizing enzymes, drug-transporters, proteins for pharmaceutical agents, and other drug targets has explained why some patients do not obtain the expected drug effects, show an exaggerated drug effect, or experience serious toxicity from standard drug dosages. SNPs can be expressed in the phenotype of the extensive metabolizer and in the phenotype of the poor metabolizer. Accordingly, SNPs may lead to allelic variants of a protein in which one or more of the protein functions in one population are different from those in another population. SNPs and the encoded variant peptides thus provide targets to ascertain a genetic predisposition that can affect treatment modality. For example, in a ligand-based treatment, SNPs may give rise to amino terminal extracellular domains and/or other ligand-binding regions of a receptor that are more or less active in ligand binding, thereby affecting subsequent protein activation. Accordingly, ligand dosage would necessarily be modified to maximize the therapeutic effect within a given population containing particular SNP alleles or haplotypes.

As an alternative to genotyping, specific variant proteins containing variant amino acid sequences encoded by alternative SNP alleles could be identified. Thus, pharmacogenomic characterization of an individual permits the selection of effective compounds and effective dosages of such compounds for prophylactic or therapeutic uses based on the individual's SNP genotype, thereby enhancing and optimizing the effectiveness of the therapy. Furthermore, the production of recombinant cells and transgenic animals containing particular SNPs/haplotypes allow effective clinical design and testing of treatment compounds and dosage regimens. For example, transgenic animals can be produced that differ only in specific SNP alleles in a gene that is orthologous to a human disease susceptibility gene.

Pharmacogenomic uses of the SNPs of the present invention provide several significant advantages for patient care, particularly in predicting an individual's predisposition to autoimmune disease (e.g., RA) and in predicting an individual's responsiveness to a drug (particularly for treating or preventing autoimmune disease). Pharmacogenomic characterization of an individual, based on an individual's SNP genotype, can identify those individuals unlikely to respond to treatment with a particular medication and thereby allows physicians to avoid prescribing the ineffective medication to those individuals. On the other hand, SNP genotyping of an individual may enable physicians to select the appropriate medication and dosage regimen that will be most effective based on an individual's SNP genotype. This information increases a physician's confidence in prescribing medications and motivates patients to comply with their drug regimens. Furthermore, pharmacogenomics may identify patients predisposed to toxicity and adverse reactions to particular drugs or drug dosages. Adverse drug reactions lead to more than 100,000 avoidable deaths per year in the United States alone and therefore represent a significant cause of hospitalization and death, as well as a significant economic burden on the healthcare system (Pfost et al., *Trends in Biotechnology*, August 2000.). Thus, pharmacogenomics based on the SNPs disclosed herein has the potential to both save lives and reduce healthcare costs substantially.

Pharmacogenomics in general is discussed further in Rose et al., "Pharmacogenetic analysis of clinically relevant genetic polymorphisms," *Methods Mol Med* 85:225-37 (2003). Pharmacogenomics as it relates to Alzheimer's disease and other neurodegenerative disorders is discussed in Cacabelos, "Pharmacogenomics for the treatment of dementia," *Ann Med* 34(5):357-79 (2002); Maimone et al., "Pharmacogenomics of neurodegenerative diseases," *Eur J Pharmacol* 413(1):11-29 (February 2001); and Poirier, "Apolipoprotein E: a pharmacogenetic target for the treatment of Alzheimer's disease," *Mol Diagn* 4(4):335-41 (Dec. 1999). Pharmacogenomics as it relates to cardiovascular disorders is discussed in Siest et al., "Pharmacogenomics of drugs affecting the cardiovascular system," *Clin Chem Lab Med* 41(4):590-9 (April 2003); Mukherjee et al., "Pharmacogenomics in cardiovascular diseases," *Prog Cardiovasc Dis* 44(6):479-98 (May-June 2002); and Mooser et al., "Cardiovascular pharmacogenetics in the SNP era," *J Thromb Haemost* 1(7):1398-402 (July 2003). Pharmacogenomics as it relates to cancer is discussed in McLeod et al., "Cancer pharmacogenomics: SNPs, chips, and the individual patient," *Cancer Invest* 21(4):630-40 (2003); and Watters et al., "Cancer pharmacogenomics: current and future applications," *Biochim Biophys Acta* 1603(2):99-111 (March 2003).

Clinical Trials

In certain aspects of the invention, there are provided methods of using the SNPs disclosed herein to identify or stratify patient populations for clinical trials of a therapeutic, preventive, or diagnostic agent.

For instance, an aspect of the present invention includes selecting individuals for clinical trials based on their SNP genotype. For example, individuals with SNP genotypes that indicate that they are likely to positively respond to a drug can be included in the trials, whereas those individuals whose SNP genotypes indicate that they are less likely to or would not respond to the drug, or who are at risk for suffering toxic effects or other adverse reactions, can be excluded from the clinical trials. This not only can improve the safety of clinical trials, but also can enhance the chances that the trial will demonstrate statistically significant efficacy.

In certain exemplary embodiments, SNPs of the invention can be used to select individuals who are unlikely to respond positively to a particular therapeutic agent (or class of therapeutic agents) based on their SNP genotype(s) to participate in a clinical trial of another type of drug that may benefit them. Thus, in certain embodiments, the SNPs of the invention can be used to identify patient populations who do not adequately respond to current treatments and are therefore in need of new therapies. This not only benefits the patients themselves, but also benefits organizations such as pharmaceutical companies by enabling the identification of populations that represent markets for new drugs, and enables the efficacy of these new drugs to be tested during clinical trials directly in individuals within these markets.

The SNP-containing nucleic acid molecules of the present invention are also useful for monitoring the effectiveness of modulating compounds on the expression or activity of a variant gene, or encoded product, particularly in a treatment regimen or in clinical trials. Thus, the gene expression pattern can serve as an indicator for the continuing effectiveness of treatment with the compound, particularly with compounds to which a patient can develop resistance, as well as an indicator for toxicities. The gene expression pattern can also serve as a marker indicative of a physiological response of the affected cells to the compound. Accordingly, such monitoring would allow either increased administration of the compound or the administration of alternative compounds to which the patient has not become resistant.

Furthermore, the SNPs of the present invention may have utility in determining why certain previously developed drugs performed poorly in clinical trials and may help identify a subset of the population that would benefit from a drug that had previously performed poorly in clinical trials, thereby "rescuing" previously developed drugs, and enabling the drug to be made available to a particular autoimmune disease patient population that can benefit from it.

Identification, Screening, and Use of Therapeutic Agents

The SNPs of the present invention also can be used to identify novel therapeutic targets for autoimmune disease. For example, genes containing the disease-associated variants ("variant genes") or their products, as well as genes or their products that are directly or indirectly regulated by or interacting with these variant genes or their products, can be targeted for the development of therapeutics that, for example, treat the disease or prevent or delay disease onset. The therapeutics may be composed of, for example, small molecules, proteins, protein fragments or peptides, antibodies, nucleic acids, or their derivatives or mimetics which modulate the functions or levels of the target genes or gene products.

The invention further provides methods for identifying a compound or agent that can be used to treat autoimmune disease. The SNPs disclosed herein are useful as targets for the identification and/or development of therapeutic agents. A method for identifying a therapeutic agent or compound typically includes assaying the ability of the agent or compound to modulate the activity and/or expression of a SNP-containing nucleic acid or the encoded product and thus identifying an agent or a compound that can be used to treat a disorder characterized by undesired activity or expression of the SNP-containing nucleic acid or the encoded product. The assays can be performed in cell-based and cell-free systems. Cell-based assays can include cells naturally expressing the nucleic acid molecules of interest or recombinant cells genetically engineered to express certain nucleic acid molecules.

Variant gene expression in a autoimmune disease patient can include, for example, either expression of a SNP-containing nucleic acid sequence (for instance, a gene that contains a SNP can be transcribed into an mRNA transcript molecule containing the SNP, which can in turn be translated into a variant protein) or altered expression of a normal/wild-type nucleic acid sequence due to one or more SNPs (for instance, a regulatory/control region can contain a SNP that affects the level or pattern of expression of a normal transcript).

Assays for variant gene expression can involve direct assays of nucleic acid levels (e.g., mRNA levels), expressed protein levels, or of collateral compounds involved in a signal pathway. Further, the expression of genes that are up- or down-regulated in response to the signal pathway can also be assayed. In this embodiment, the regulatory regions of these genes can be operably linked to a reporter gene such as luciferase.

Modulators of variant gene expression can be identified in a method wherein, for example, a cell is contacted with a candidate compound/agent and the expression of mRNA determined. The level of expression of mRNA in the presence of the candidate compound is compared to the level of expression of mRNA in the absence of the candidate compound. The candidate compound can then be identified as a modulator of variant gene expression based on this comparison and be used to treat a disorder such as autoimmune disease that is characterized by variant gene expression (e.g., either expression of a SNP-containing nucleic acid or altered expression of a normal/wild-type nucleic acid molecule due to one or more SNPs that affect expression of the nucleic acid molecule) due to one or more SNPs of the present invention. When expression of mRNA is statistically significantly greater in the presence of the candidate compound than in its absence, the candidate compound is identified as a stimulator of nucleic acid expression. When nucleic acid expression is statistically significantly less in the presence of the candidate compound than in its absence, the candidate compound is identified as an inhibitor of nucleic acid expression.

The invention further provides methods of treatment, with the SNP or associated nucleic acid domain (e.g., catalytic domain, ligand/substrate-binding domain, regulatory/control region, etc.) or gene, or the encoded mRNA transcript, as a target, using a compound identified through drug screening as a gene modulator to modulate variant nucleic acid expression. Modulation can include either up-regulation (i.e., activation or agonization) or down-regulation (i.e., suppression or antagonization) of nucleic acid expression.

Expression of mRNA transcripts and encoded proteins, either wild type or variant, may be altered in individuals with a particular SNP allele in a regulatory/control element, such as a promoter or transcription factor binding domain, that regulates expression. In this situation, methods of treatment and compounds can be identified, as discussed herein, that regulate or overcome the variant regulatory/control element, thereby generating normal, or healthy, expression levels of either the wild type or variant protein.

Pharmaceutical Compositions and Administration Thereof

Any of the autoimmune disease-associated proteins, and encoding nucleic acid molecules, disclosed herein can be used as therapeutic targets (or directly used themselves as therapeutic compounds) for treating or preventing autoimmune disease or related pathologies, and the present disclosure enables therapeutic compounds (e.g., small molecules, antibodies, therapeutic proteins, RNAi and antisense molecules, etc.) to be developed that target (or are comprised of) any of these therapeutic targets.

In general, a therapeutic compound will be administered in a therapeutically effective amount by any of the accepted modes of administration for agents that serve similar utilities. The actual amount of the therapeutic compound of this invention, i.e., the active ingredient, will depend upon numerous factors such as the severity of the disease to be treated, the age and relative health of the subject, the potency of the compound used, the route and form of administration, and other factors.

Therapeutically effective amounts of therapeutic compounds may range from, for example, approximately 0.01-50 mg per kilogram body weight of the recipient per day; preferably about 0.1-20 mg/kg/day. Thus, as an example, for administration to a 70-kg person, the dosage range would most preferably be about 7 mg to 1.4 g per day.

In general, therapeutic compounds will be administered as pharmaceutical compositions by any one of the following routes: oral, systemic (e.g., transdermal, intranasal, or by suppository), or parenteral (e.g., intramuscular, intravenous, or subcutaneous) administration. The preferred manner of administration is oral or parenteral using a convenient daily dosage regimen, which can be adjusted according to the degree of affliction. Oral compositions can take the form of tablets, pills, capsules, semisolids, powders, sustained release formulations, solutions, suspensions, elixirs, aerosols, or any other appropriate compositions.

The choice of formulation depends on various factors such as the mode of drug administration (e.g., for oral administration, formulations in the form of tablets, pills, or capsules are preferred) and the bioavailability of the drug substance. Recently, pharmaceutical formulations have been developed especially for drugs that show poor bioavailability based upon the principle that bioavailability can be increased by increasing the surface area, i.e., decreasing particle size. For example, U.S. Pat. No. 4,107,288 describes a pharmaceutical formulation having particles in the size range from 10 to 1,000 nm in which the active material is supported on a cross-linked matrix of macromolecules. U.S. Pat. No. 5,145,684 describes the production of a pharmaceutical formulation in which the drug substance is pulverized to nanoparticles (average particle size of 400 nm) in the presence of a surface modifier and then dispersed in a liquid medium to give a pharmaceutical formulation that exhibits remarkably high bioavailability.

Pharmaceutical compositions are comprised of, in general, a therapeutic compound in combination with at least one pharmaceutically acceptable excipient. Acceptable excipients are non-toxic, aid administration, and do not adversely affect the therapeutic benefit of the therapeutic compound. Such excipients may be any solid, liquid, semi-solid or, in the case of an aerosol composition, gaseous excipient that is generally available to one skilled in the art.

Solid pharmaceutical excipients include starch, cellulose, talc, glucose, lactose, sucrose, gelatin, malt, rice, flour, chalk, silica gel, magnesium stearate, sodium stearate, glycerol monostearate, sodium chloride, dried skim milk and the like. Liquid and semisolid excipients may be selected from glycerol, propylene glycol, water, ethanol and various oils, including those of petroleum, animal, vegetable or synthetic origin, e.g., peanut oil, soybean oil, mineral oil, sesame oil, etc. Preferred liquid carriers, particularly for injectable solutions, include water, saline, aqueous dextrose, and glycols.

Compressed gases may be used to disperse a compound of this invention in aerosol form. Inert gases suitable for this purpose are nitrogen, carbon dioxide, etc.

Other suitable pharmaceutical excipients and their formulations are described in *Remington's Pharmaceutical Sciences* 18$^{th}$ ed., E. W. Martin, ed., Mack Publishing Company (1990).

The amount of the therapeutic compound in a formulation can vary within the full range employed by those skilled in the art. Typically, the formulation will contain, on a weight percent (wt %) basis, from about 0.01-99.99 wt % of the therapeutic compound based on the total formulation, with the balance being one or more suitable pharmaceutical excipients. Preferably, the compound is present at a level of about 1-80% wt.

Therapeutic compounds can be administered alone or in combination with other therapeutic compounds or in combination with one or more other active ingredient(s). For example, an inhibitor or stimulator of a autoimmune disease-associated protein can be administered in combination with another agent that inhibits or stimulates the activity of the same or a different autoimmune disease-associated protein to thereby counteract the effects of autoimmune disease.

For further information regarding pharmacology, see *Current Protocols in Pharmacology*, John Wiley & Sons, Inc., N.Y.

Nucleic Acid-Based Therapeutic Agents

The SNP-containing nucleic acid molecules disclosed herein, and their complementary nucleic acid molecules, may be used as antisense constructs to control gene expression in cells, tissues, and organisms. Antisense technology is well established in the art and extensively reviewed in *Antisense Drug Technology: Principles, Strategies, and Applications*, Crooke, ed., Marcel Dekker, Inc., N.Y. (2001). An antisense nucleic acid molecule is generally designed to be complementary to a region of mRNA expressed by a gene so that the antisense molecule hybridizes to the mRNA and thereby blocks translation of mRNA into protein. Various classes of antisense oligonucleotides are used in the art, two of which are cleavers and blockers. Cleavers, by binding to target RNAs, activate intracellular nucleases (e.g., RNaseH or RNase L) that cleave the target RNA. Blockers, which also bind to target RNAs, inhibit protein translation through steric hindrance of ribosomes. Exemplary blockers include peptide nucleic acids, morpholinos, locked nucleic acids, and methylphosphonates. See, e.g., Thompson, *Drug Discovery Today* 7(17): 912-917 (2002). Antisense oligonucleotides are directly useful as therapeutic agents, and are also useful for determining and validating gene function (e.g., in gene knock-out or knock-down experiments).

Antisense technology is further reviewed in: Layery et al., "Antisense and RNAi: powerful tools in drug target discovery and validation," *Curr Opin Drug Discov Devel* 6(4):561-9 (July 2003); Stephens et al., "Antisense oligonucleotide therapy in cancer," *Curr Opin Mol Ther* 5(2):118-22 (April 2003); Kurreck, "Antisense technologies. Improvement through novel chemical modifications," *Eur J Biochem* 270 (8):1628-44 (April 2003); Dias et al., "Antisense oligonucleotides: basic concepts and mechanisms," *Mol Cancer Ther* 1(5):347-55 (March 2002); Chen, "Clinical development of antisense oligonucleotides as anti-cancer therapeutics," *Methods Mol Med* 75:621-36 (2003); Wang et al., "Antisense anticancer oligonucleotide therapeutics," *Curr Cancer Drug Targets* 1(3):177-96 (November 2001); and Bennett, "Efficiency of antisense oligonucleotide drug discovery," *Antisense Nucleic Acid Drug Dev* 12(3):215-24 (June 2002).

The SNPs of the present invention are particularly useful for designing antisense reagents that are specific for particular nucleic acid variants. Based on the SNP information disclosed herein, antisense oligonucleotides can be produced that specifically target mRNA molecules that contain one or more particular SNP nucleotides. In this manner, expression of mRNA molecules that contain one or more undesired polymorphisms (e.g., SNP nucleotides that lead to a defective protein such as an amino acid substitution in a catalytic domain) can be inhibited or completely blocked. Thus, antisense oligonucleotides can be used to specifically bind a particular polymorphic form (e.g., a SNP allele that encodes a defective protein), thereby inhibiting translation of this form, but which do not bind an alternative polymorphic form (e.g., an alternative SNP nucleotide that encodes a protein having normal function).

Antisense molecules can be used to inactivate mRNA in order to inhibit gene expression and production of defective proteins. Accordingly, these molecules can be used to treat a disorder, such as autoimmune disease, characterized by abnormal or undesired gene expression or expression of certain defective proteins. This technique can involve cleavage by means of ribozymes containing nucleotide sequences complementary to one or more regions in the mRNA that attenuate the ability of the mRNA to be translated. Possible mRNA regions include, for example, protein-coding regions and particularly protein-coding regions corresponding to catalytic activities, substrate/ligand binding, or other functional activities of a protein.

The SNPs of the present invention are also useful for designing RNA interference reagents that specifically target nucleic acid molecules having particular SNP variants. RNA interference (RNAi), also referred to as gene silencing, is based on using double-stranded RNA (dsRNA) molecules to turn genes off. When introduced into a cell, dsRNAs are processed by the cell into short fragments (generally about 21, 22, or 23 nucleotides in length) known as small interfering RNAs (siRNAs) which the cell uses in a sequence-specific manner to recognize and destroy complementary RNAs. Thompson, *Drug Discovery Today* 7(17): 912-917 (2002). Accordingly, an aspect of the present invention specifically contemplates isolated nucleic acid molecules that are about 18-26 nucleotides in length, preferably 19-25 nucleotides in length, and more preferably 20, 21, 22, or 23 nucleotides in length, and the use of these nucleic acid molecules for RNAi. Because RNAi molecules, including siRNAs, act in a sequence-specific manner, the SNPs of the present invention can be used to design RNAi reagents that recognize and destroy nucleic acid molecules having specific SNP alleles/nucleotides (such as deleterious alleles that lead to the production of defective proteins), while not affecting nucleic acid molecules having alternative SNP alleles (such as alleles that encode proteins having normal function). As with antisense reagents, RNAi reagents may be directly useful as therapeutic agents (e.g., for turning off defective, disease-causing genes), and are also useful for characterizing and validating gene function (e.g., in gene knock-out or knock-down experiments).

The following references provide a further review of RNAi: Reynolds et al., "Rational siRNA design for RNA interference," *Nat Biotechnol* 22(3):326-30 (March 2004); Epub Feb. 1, 2004; Chi et al., "Genomewide view of gene silencing by small interfering RNAs," *PNAS* 100(11):6343-6346 (2003); Vickers et al., "Efficient Reduction of Target RNAs by Small Interfering RNA and RNase H-dependent Antisense Agents," *J Biol Chem* 278:7108-7118 (2003); Agami, "RNAi and related mechanisms and their potential use for therapy," *Curr Opin Chem Biol* 6(6):829-34 (December 2002); Layery et al., "Antisense and RNAi: powerful tools in drug target discovery and validation," *Curr Opin Drug Discov Devel* 6(4):561-9 (July 2003); Shi, "Mammalian RNAi for the masses," *Trends Genet.* 19(1):9-12 (January 2003); Shuey et al., "RNAi: gene-silencing in therapeutic intervention," *Drug Discovery Today* 7(20):1040-1046 (October 2002); McManus et al., *Nat Rev Genet.* 3(10):737-47 (October 2002); Xia et al., *Nat Biotechnol* 20(10):1006-10 (October 2002); Plasterk et al., *Curr Opin Genet Dev* 10(5): 562-7 (October 2000); Bosher et al., *Nat Cell Biol* 2(2):E31-6 (February 2000); and Hunter, *Curr Biol* 17; 9(12):R440-2 (June 1999).

Other Therapeutic Aspects

SNPs have many important uses in drug discovery, screening, and development, and thus the SNPs of the present invention are useful for improving many different aspects of the drug development process.

For example, a high probability exists that, for any gene/protein selected as a potential drug target, variants of that gene/protein will exist in a patient population. Thus, determining the impact of gene/protein variants on the selection and delivery of a therapeutic agent should be an integral aspect of the drug discovery and development process. Jazwinska, *A Trends Guide to Genetic Variation and Genomic Medicine* S30-S36 (March 2002).

Knowledge of variants (e.g., SNPs and any corresponding amino acid polymorphisms) of a particular therapeutic target (e.g., a gene, mRNA transcript, or protein) enables parallel screening of the variants in order to identify therapeutic candidates (e.g., small molecule compounds, antibodies, antisense or RNAi nucleic acid compounds, etc.) that demonstrate efficacy across variants. Rothberg, *Nat Biotechnol* 19(3):209-11 (March 2001). Such therapeutic candidates would be expected to show equal efficacy across a larger segment of the patient population, thereby leading to a larger potential market for the therapeutic candidate.

Furthermore, identifying variants of a potential therapeutic target enables the most common form of the target to be used for selection of therapeutic candidates, thereby helping to ensure that the experimental activity that is observed for the selected candidates reflects the real activity expected in the largest proportion of a patient population. Jazwinska, *A Trends Guide to Genetic Variation and Genomic Medicine* S30-S36 (March 2002).

Additionally, screening therapeutic candidates against all known variants of a target can enable the early identification of potential toxicities and adverse reactions relating to particular variants. For example, variability in drug absorption, distribution, metabolism and excretion (ADME) caused by, for example, SNPs in therapeutic targets or drug metabolizing genes, can be identified, and this information can be utilized during the drug development process to minimize variability in drug disposition and develop therapeutic agents that are safer across a wider range of a patient population. The SNPs of the present invention, including the variant proteins and encoding polymorphic nucleic acid molecules provided in Tables 1 and 2, are useful in conjunction with a variety of toxicology methods established in the art, such as those set forth in *Current Protocols in Toxicology*, John Wiley & Sons, Inc., N.Y.

Furthermore, therapeutic agents that target any art-known proteins (or nucleic acid molecules, either RNA or DNA) may cross-react with the variant proteins (or polymorphic nucleic acid molecules) disclosed in Table 1, thereby significantly affecting the pharmacokinetic properties of the drug. Consequently, the protein variants and the SNP-containing nucleic acid molecules disclosed in Tables 1 and 2 are useful in developing, screening, and evaluating therapeutic agents that target corresponding art-known protein forms (or nucleic acid molecules). Additionally, as discussed above, knowledge of all polymorphic forms of a particular drug target enables the design of therapeutic agents that are effective against most or all such polymorphic forms of the drug target.

A subject suffering from a pathological condition ascribed to a SNP, such as autoimmune disease, may be treated so as to correct the genetic defect. See Kren et al., *Proc Natl Acad Sci USA* 96:10349-10354 (1999). Such a subject can be identified by any method that can detect the polymorphism in a biological sample drawn from the subject. Such a genetic defect may be permanently corrected by administering to such a subject a nucleic acid fragment incorporating a repair sequence that supplies the normal/wild-type nucleotide at the position of the SNP. This site-specific repair sequence can encompass an RNA/DNA oligonucleotide that operates to promote endogenous repair of a subject's genomic DNA. The site-specific repair sequence is administered in an appropriate vehicle, such as a complex with polyethylenimine, encapsulated in anionic liposomes, a viral vector such as an adenovirus, or other pharmaceutical composition that promotes intracellular uptake of the administered nucleic acid. A genetic defect leading to an inborn pathology may then be overcome, as the chimeric oligonucleotides induce incorporation of the normal sequence into the subject's genome. Upon incorporation, the normal gene product is expressed, and the replacement is propagated, thereby engendering a permanent repair and therapeutic enhancement of the clinical condition of the subject.

In cases in which a cSNP results in a variant protein that is ascribed to be the cause of, or a contributing factor to, a pathological condition, a method of treating such a condition can include administering to a subject experiencing the pathology the wild-type/normal cognate of the variant protein. Once administered in an effective dosing regimen, the wild-type cognate provides complementation or remediation of the pathological condition.

Human Identification Applications

In addition to their predictive, diagnostic, prognostic, therapeutic, and preventive uses in autoimmune disease and related pathologies, the SNPs provided by the present invention are also useful as human identification markers for such applications as forensics, paternity testing, and biometrics. See, e.g., Gill, "An assessment of the utility of single nucleotide polymorphisms (SNPs) for forensic purposes," *Int J Legal Med* 114(4-5):204-10 (2001). Genetic variations in the nucleic acid sequences between individuals can be used as genetic markers to identify individuals and to associate a biological sample with an individual. Determination of which nucleotides occupy a set of SNP positions in an individual identifies a set of SNP markers that distinguishes the individual. The more SNP positions that are analyzed, the lower the probability that the set of SNPs in one individual is the same as that in an unrelated individual. Preferably, if multiple sites are analyzed, the sites are unlinked (i.e., inherited independently). Thus, preferred sets of SNPs can be selected from among the SNPs disclosed herein, which may include SNPs on different chromosomes, SNPs on different chromosome arms, and/or SNPs that are dispersed over substantial distances along the same chromosome arm.

Furthermore, among the SNPs disclosed herein, preferred SNPs for use in certain forensic/human identification applications include SNPs located at degenerate codon positions (i.e., the third position in certain codons which can be one of two or more alternative nucleotides and still encode the same amino acid), since these SNPs do not affect the encoded protein. SNPs that do not affect the encoded protein are expected to be under less selective pressure and are therefore expected to be more polymorphic in a population, which is typically an advantage for forensic/human identification applications. However, for certain forensics/human identification applications, such as predicting phenotypic characteristics (e.g., inferring ancestry or inferring one or more physical characteristics of an individual) from a DNA sample, it may be desirable to utilize SNPs that affect the encoded protein.

For many of the SNPs disclosed in Tables 1 and 2 (which are identified as "Applera" SNP source), Tables 1 and 2 provide SNP allele frequencies obtained by re-sequencing the DNA of chromosomes from 39 individuals (Tables 1 and 2 also provide allele frequency information for "Celera" source SNPs and, where available, public SNPs from dbEST, HGBASE, and/or HGMD). The allele frequencies provided in Tables 1 and 2 enable these SNPs to be readily used for human identification applications. Although any SNP disclosed in Table 1 and/or Table 2 could be used for human identification, the closer that the frequency of the minor allele at a particular SNP site is to 50%, the greater the ability of that SNP to discriminate between different individuals in a population since it becomes increasingly likely that two randomly selected individuals would have different alleles at that SNP site. Using the SNP allele frequencies provided in Tables 1 and 2, one of ordinary skill in the art could readily select a subset of SNPs for which the frequency of the minor allele is, for example, at least 1%, 2%, 5%, 10%, 20%, 25%, 30%, 40%, 45%, or 50%, or any other frequency in-between. Thus, since Tables 1 and 2 provide allele frequencies based on the re-sequencing of the chromosomes from 39 individuals, a subset of SNPs could readily be selected for human identification in which the total allele count of the minor allele at a particular SNP site is, for example, at least 1, 2, 4, 8, 10, 16, 20, 24, 30, 32, 36, 38, 39, 40, or any other number in-between.

Furthermore, Tables 1 and 2 also provide population group (interchangeably referred to herein as ethnic or racial groups) information coupled with the extensive allele frequency information. For example, the group of 39 individuals whose DNA was re-sequenced was made-up of 20 Caucasians and 19 African-Americans. This population group information enables further refinement of SNP selection for human identification. For example, preferred SNPs for human identification can be selected from Tables 1 and 2 that have similar allele frequencies in both the Caucasian and African-American populations; thus, for example, SNPs can be selected that have equally high discriminatory power in both populations. Alternatively, SNPs can be selected for which there is a statistically significant difference in allele frequencies between the Caucasian and African-American populations (as an extreme example, a particular allele may be observed only in either the Caucasian or the African-American population group but not observed in the other population group); such SNPs are useful, for example, for predicting the race/ethnicity of an unknown perpetrator from a biological sample such as a hair or blood stain recovered at a crime scene. For a discussion of using SNPs to predict ancestry from a DNA sample, including statistical methods, see Frudakis et al., "A Classifier for the SNP-Based Inference of Ancestry," *Journal of Forensic Sciences* 48(4):771-782 (2003).

SNPs have numerous advantages over other types of polymorphic markers, such as short tandem repeats (STRs). For example, SNPs can be easily scored and are amenable to automation, making SNPs the markers of choice for large-scale forensic databases. SNPs are found in much greater abundance throughout the genome than repeat polymorphisms. Population frequencies of two polymorphic forms can usually be determined with greater accuracy than those of multiple polymorphic forms at multi-allelic loci. SNPs are mutationally more stable than repeat polymorphisms. SNPs are not susceptible to artifacts such as stutter bands that can hinder analysis. Stutter bands are frequently encountered when analyzing repeat polymorphisms, and are particularly troublesome when analyzing samples such as crime scene samples that may contain mixtures of DNA from multiple sources. Another significant advantage of SNP markers over STR markers is the much shorter length of nucleic acid needed to score a SNP. For example, STR markers are generally several hundred base pairs in length. A SNP, on the other hand, comprises a single nucleotide, and generally a short conserved region on either side of the SNP position for primer and/or probe binding. This makes SNPs more amenable to typing in highly degraded or aged biological samples that are frequently encountered in forensic casework in which DNA may be fragmented into short pieces.

SNPs also are not subject to microvariant and "off-ladder" alleles frequently encountered when analyzing STR loci. Microvariants are deletions or insertions within a repeat unit that change the size of the amplified DNA product so that the amplified product does not migrate at the same rate as reference alleles with normal sized repeat units. When separated by size, such as by electrophoresis on a polyacrylamide gel, microvariants do not align with a reference allelic ladder of standard sized repeat units, but rather migrate between the reference alleles. The reference allelic ladder is used for precise sizing of alleles for allele classification; therefore alleles that do not align with the reference allelic ladder lead to substantial analysis problems. Furthermore, when analyzing multi-allelic repeat polymorphisms, occasionally an allele is found that consists of more or less repeat units than has been previously seen in the population, or more or less repeat alleles than are included in a reference allelic ladder. These alleles will migrate outside the size range of known alleles in a reference allelic ladder, and therefore are referred to as "off-ladder" alleles. In extreme cases, the allele may contain so few or so many repeats that it migrates well out of the range of the reference allelic ladder. In this situation, the allele may not even be observed, or, with multiplex analysis, it may migrate within or close to the size range for another locus, further confounding analysis.

SNP analysis avoids the problems of microvariants and off-ladder alleles encountered in STR analysis. Importantly, microvariants and off-ladder alleles may provide significant problems, and may be completely missed, when using analysis methods such as oligonucleotide hybridization arrays, which utilize oligonucleotide probes specific for certain known alleles. Furthermore, off-ladder alleles and microvariants encountered with STR analysis, even when correctly typed, may lead to improper statistical analysis, since their frequencies in the population are generally unknown or poorly characterized, and therefore the statistical significance of a matching genotype may be questionable. All these advantages of SNP analysis are considerable in light of the consequences of most DNA identification cases, which may lead to life imprisonment for an individual, or re-association of remains to the family of a deceased individual.

DNA can be isolated from biological samples such as blood, bone, hair, saliva, or semen, and compared with the DNA from a reference source at particular SNP positions. Multiple SNP markers can be assayed simultaneously in order to increase the power of discrimination and the statistical significance of a matching genotype. For example, oligonucleotide arrays can be used to genotype a large number of SNPs simultaneously. The SNPs provided by the present invention can be assayed in combination with other polymorphic genetic markers, such as other SNPs known in the art or STRs, in order to identify an individual or to associate an individual with a particular biological sample.

Furthermore, the SNPs provided by the present invention can be genotyped for inclusion in a database of DNA genotypes, for example, a criminal DNA databank such as the FBI's Combined DNA Index System (CODIS) database. A genotype obtained from a biological sample of unknown source can then be queried against the database to find a matching genotype, with the SNPs of the present invention providing nucleotide positions at which to compare the known and unknown DNA sequences for identity. Accordingly, the present invention provides a database comprising novel SNPs or SNP alleles of the present invention (e.g., the database can comprise information indicating which alleles are possessed by individual members of a population at one or more novel SNP sites of the present invention), such as for use in forensics, biometrics, or other human identification applications. Such a database typically comprises a computer-based system in which the SNPs or SNP alleles of the present invention are recorded on a computer readable medium.

The SNPs of the present invention can also be assayed for use in paternity testing. The object of paternity testing is usually to determine whether a male is the father of a child. In most cases, the mother of the child is known and thus, the mother's contribution to the child's genotype can be traced. Paternity testing investigates whether the part of the child's genotype not attributable to the mother is consistent with that of the putative father. Paternity testing can be performed by analyzing sets of polymorphisms in the putative father and the child, with the SNPs of the present invention providing nucleotide positions at which to compare the putative father's and child's DNA sequences for identity. If the set of polymorphisms in the child attributable to the father does not match the set of polymorphisms of the putative father, it can be concluded, barring experimental error, that the putative father is not the father of the child. If the set of polymorphisms in the child attributable to the father match the set of polymorphisms of the putative father, a statistical calculation can be performed to determine the probability of coincidental match, and a conclusion drawn as to the likelihood that the putative father is the true biological father of the child.

In addition to paternity testing, SNPs are also useful for other types of kinship testing, such as for verifying familial relationships for immigration purposes, or for cases in which an individual alleges to be related to a deceased individual in order to claim an inheritance from the deceased individual, etc. For further information regarding the utility of SNPs for paternity testing and other types of kinship testing, including methods for statistical analysis, see Krawczak, "Informativity assessment for biallelic single nucleotide polymorphisms," *Electrophoresis* 20(8):1676-81 (June 1999).

The use of the SNPs of the present invention for human identification further extends to various authentication systems, commonly referred to as biometric systems, which typically convert physical characteristics of humans (or other organisms) into digital data. Biometric systems include various technological devices that measure such unique anatomical or physiological characteristics as finger, thumb, or palm prints; hand geometry; vein patterning on the back of the hand; blood vessel patterning of the retina and color and texture of the iris; facial characteristics; voice patterns; signature and typing dynamics; and DNA. Such physiological measurements can be used to verify identity and, for example, restrict or allow access based on the identification. Examples of applications for biometrics include physical area security, computer and network security, aircraft passenger check-in and boarding, financial transactions, medical records access, government benefit distribution, voting, law enforcement, passports, visas and immigration, prisons, various military applications, and for restricting access to expensive or dangerous items, such as automobiles or guns. See, for example, O'Connor, *Stanford Technology Law Review*, and U.S. Pat. No. 6,119,096.

Groups of SNPs, particularly the SNPs provided by the present invention, can be typed to uniquely identify an individual for biometric applications such as those described above. Such SNP typing can readily be accomplished using, for example, DNA chips/arrays. Preferably, a minimally invasive means for obtaining a DNA sample is utilized. For example, PCR amplification enables sufficient quantities of DNA for analysis to be obtained from buccal swabs or fingerprints, which contain DNA-containing skin cells and oils that are naturally transferred during contact.

Further information regarding techniques for using SNPs in forensic/human identification applications can be found, for example, in *Current Protocols in Human Genetics* 14.1-14.7, John Wiley & Sons, N.Y. (2002).

Variant Proteins, Antibodies, Vectors, Host Cells, & Uses Thereof

Variant Proteins Encoded by SNP-Containing Nucleic Acid Molecules

The present invention provides SNP-containing nucleic acid molecules, many of which encode proteins having variant amino acid sequences as compared to the art-known (i.e., wild-type) proteins. Amino acid sequences encoded by the polymorphic nucleic acid molecules of the present invention are referred to as SEQ ID NOS:17-32 in Table 1 and provided in the Sequence Listing. These variants will generally be referred to herein as variant proteins/peptides/polypeptides, or polymorphic proteins/peptides/polypeptides of the present invention. The terms "protein," "peptide," and "polypeptide" are used herein interchangeably.

A variant protein of the present invention may be encoded by, for example, a nonsynonymous nucleotide substitution at any one of the cSNP positions disclosed herein. In addition, variant proteins may also include proteins whose expression, structure, and/or function is altered by a SNP disclosed herein, such as a SNP that creates or destroys a stop codon, a SNP that affects splicing, and a SNP in control/regulatory elements, e.g. promoters, enhancers, or transcription factor binding domains.

As used herein, a protein or peptide is said to be "isolated" or "purified" when it is substantially free of cellular material or chemical precursors or other chemicals. The variant proteins of the present invention can be purified to homogeneity or other lower degrees of purity. The level of purification will be based on the intended use. The key feature is that the preparation allows for the desired function of the variant protein, even if in the presence of considerable amounts of other components.

As used herein, "substantially free of cellular material" includes preparations of the variant protein having less than about 30% (by dry weight) other proteins (i.e., contaminating protein), less than about 20% other proteins, less than about 10% other proteins, or less than about 5% other proteins. When the variant protein is recombinantly produced, it can also be substantially free of culture medium, i.e., culture medium represents less than about 20% of the volume of the protein preparation.

The language "substantially free of chemical precursors or other chemicals" includes preparations of the variant protein in which it is separated from chemical precursors or other chemicals that are involved in its synthesis. In one embodiment, the language "substantially free of chemical precursors or other chemicals" includes preparations of the variant protein having less than about 30% (by dry weight) chemical precursors or other chemicals, less than about 20% chemical precursors or other chemicals, less than about 10% chemical precursors or other chemicals, or less than about 5% chemical precursors or other chemicals.

An isolated variant protein may be purified from cells that naturally express it, purified from cells that have been altered to express it (recombinant host cells), or synthesized using known protein synthesis methods. For example, a nucleic acid molecule containing SNP(s) encoding the variant protein can be cloned into an expression vector, the expression vector introduced into a host cell, and the variant protein expressed in the host cell. The variant protein can then be isolated from the cells by any appropriate purification scheme using standard protein purification techniques. Examples of these techniques are described in detail below. Sambrook and Russell, *Molecular Cloning: A Laboratory Manual*, Cold Spring Harbor Laboratory Press, N.Y. (2000).

The present invention provides isolated variant proteins that comprise, consist of or consist essentially of amino acid sequences that contain one or more variant amino acids encoded by one or more codons that contain a SNP of the present invention.

Accordingly, the present invention provides variant proteins that consist of amino acid sequences that contain one or more amino acid polymorphisms (or truncations or extensions due to creation or destruction of a stop codon, respectively) encoded by the SNPs provided in Table 1 and/or Table 2. A protein consists of an amino acid sequence when the amino acid sequence is the entire amino acid sequence of the protein.

The present invention further provides variant proteins that consist essentially of amino acid sequences that contain one or more amino acid polymorphisms (or truncations or extensions due to creation or destruction of a stop codon, respectively) encoded by the SNPs provided in Table 1 and/or Table 2. A protein consists essentially of an amino acid sequence when such an amino acid sequence is present with only a few additional amino acid residues in the final protein.

The present invention further provides variant proteins that comprise amino acid sequences that contain one or more amino acid polymorphisms (or truncations or extensions due to creation or destruction of a stop codon, respectively) encoded by the SNPs provided in Table 1 and/or Table 2. A protein comprises an amino acid sequence when the amino acid sequence is at least part of the final amino acid sequence of the protein. In such a fashion, the protein may contain only the variant amino acid sequence or have additional amino acid residues, such as a contiguous encoded sequence that is naturally associated with it or heterologous amino acid residues. Such a protein can have a few additional amino acid residues or can comprise many more additional amino acids. A brief description of how various types of these proteins can be made and isolated is provided below.

The variant proteins of the present invention can be attached to heterologous sequences to form chimeric or fusion proteins. Such chimeric and fusion proteins comprise a variant protein operatively linked to a heterologous protein having an amino acid sequence not substantially homologous to the variant protein. "Operatively linked" indicates that the coding sequences for the variant protein and the heterologous protein are ligated in-frame. The heterologous protein can be fused to the N-terminus or C-terminus of the variant protein. In another embodiment, the fusion protein is encoded by a fusion polynucleotide that is synthesized by conventional techniques including automated DNA synthesizers. Alternatively, PCR amplification of gene fragments can be carried out using anchor primers which give rise to complementary overhangs between two consecutive gene fragments which can subsequently be annealed and re-amplified to generate a chimeric gene sequence. See Ausubel et al., *Current Protocols in Molecular Biology* (1992). Moreover, many expression vectors are commercially available that already encode a fusion moiety (e.g., a GST protein). A variant protein-encoding nucleic acid can be cloned into such an expression vector such that the fusion moiety is linked in-frame to the variant protein.

In many uses, the fusion protein does not affect the activity of the variant protein. The fusion protein can include, but is not limited to, enzymatic fusion proteins, for example, beta-galactosidase fusions, yeast two-hybrid GAL fusions, poly-His fusions, MYC-tagged, HI-tagged and Ig fusions. Such fusion proteins, particularly poly-His fusions, can facilitate their purification following recombinant expression. In certain host cells (e.g., mammalian host cells), expression and/or secretion of a protein can be increased by using a heterologous signal sequence. Fusion proteins are further described in, for example, Terpe, "Overview of tag protein fusions: from molecular and biochemical fundamentals to commercial systems," *Appl Microbiol Biotechnol* 60(5):523-33 (January 2003); Epub Nov. 7, 2002; Graddis et al., "Designing proteins that work using recombinant technologies," *Curr Pharm Biotechnol* 3(4):285-97 (December 2002); and Nilsson et al., "Affinity fusion strategies for detection, purification, and immobilization of recombinant proteins," *Protein Expr Purif* 11(1): 1-16 (October 1997).

In certain embodiments, novel compositions of the present invention also relate to further obvious variants of the variant polypeptides of the present invention, such as naturally-occurring mature forms (e.g., allelic variants), non-naturally occurring recombinantly-derived variants, and orthologs and paralogs of such proteins that share sequence homology. Such variants can readily be generated using art-known techniques in the fields of recombinant nucleic acid technology and protein biochemistry.

Further variants of the variant polypeptides disclosed in Table 1 can comprise an amino acid sequence that shares at least 70-80%, 80-85%, 85-90%, 91%, 92%, 93%, 94%, 95%, 96%, 97%, 98%, or 99% sequence identity with an amino acid sequence disclosed in Table 1 (or a fragment thereof) and that includes a novel amino acid residue (allele) disclosed in Table 1 (which is encoded by a novel SNP allele). Thus, an aspect of the present invention that is specifically contemplated are polypeptides that have a certain degree of sequence variation compared with the polypeptide sequences shown in Table 1, but that contain a novel amino acid residue (allele) encoded by a novel SNP allele disclosed herein. In other words, as long as a polypeptide contains a novel amino acid residue disclosed herein, other portions of the polypeptide that flank the novel amino acid residue can vary to some degree from the polypeptide sequences shown in Table 1.

Full-length pre-processed forms, as well as mature processed forms, of proteins that comprise one of the amino acid sequences disclosed herein can readily be identified as having complete sequence identity to one of the variant proteins of the present invention as well as being encoded by the same genetic locus as the variant proteins provided herein.

Orthologs of a variant peptide can readily be identified as having some degree of significant sequence homology/identity to at least a portion of a variant peptide as well as being encoded by a gene from another organism. Preferred orthologs will be isolated from non-human mammals, preferably primates, for the development of human therapeutic targets and agents. Such orthologs can be encoded by a nucleic acid sequence that hybridizes to a variant peptide-encoding nucleic acid molecule under moderate to stringent conditions depending on the degree of relatedness of the two organisms yielding the homologous proteins.

Variant proteins include, but are not limited to, proteins containing deletions, additions and substitutions in the amino acid sequence caused by the SNPs of the present invention. One class of substitutions is conserved amino acid substitutions in which a given amino acid in a polypeptide is substituted for another amino acid of like characteristics. Typical conservative substitutions are replacements, one for another, among the aliphatic amino acids Ala, Val, Leu, and Ile; interchange of the hydroxyl residues Ser and Thr; exchange of the acidic residues Asp and Glu; substitution between the amide residues Asn and Gln; exchange of the basic residues Lys and Arg; and replacements among the aromatic residues Phe and Tyr. Guidance concerning which amino acid changes are likely to be phenotypically silent are found, for example, in Bowie et al., *Science* 247:1306-1310 (1990).

Variant proteins can be fully functional or can lack function in one or more activities, e.g. ability to bind another molecule, ability to catalyze a substrate, ability to mediate signaling, etc. Fully functional variants typically contain only conservative variations or variations in non-critical residues or in non-critical regions. Functional variants can also contain substitution of similar amino acids that result in no change or an insignificant change in function. Alternatively, such substitutions may positively or negatively affect function to some degree. Non-functional variants typically contain one or more non-conservative amino acid substitutions, deletions, insertions, inversions, truncations or extensions, or a substitution, insertion, inversion, or deletion of a critical residue or in a critical region.

Amino acids that are essential for function of a protein can be identified by methods known in the art, such as site-directed mutagenesis or alanine-scanning mutagenesis, particularly using the amino acid sequence and polymorphism information provided in Table 1. Cunningham et al., *Science* 244:1081-1085 (1989). The latter procedure introduces single alanine mutations at every residue in the molecule. The resulting mutant molecules are then tested for biological activity such as enzyme activity or in assays such as an in vitro proliferative activity. Sites that are critical for binding partner/substrate binding can also be determined by structural analysis such as crystallization, nuclear magnetic resonance or photoaffinity labeling. Smith et al., *J Mol Biol* 224:899-904 (1992); de Vos et al., *Science* 255:306-312 (1992).

Polypeptides can contain amino acids other than the 20 amino acids commonly referred to as the 20 naturally occurring amino acids. Further, many amino acids, including the terminal amino acids, may be modified by natural processes, such as processing and other post-translational modifications, or by chemical modification techniques well known in the art. Accordingly, the variant proteins of the present invention also encompass derivatives or analogs in which a substituted amino acid residue is not one encoded by the genetic code, in which a substituent group is included, in which the mature polypeptide is fused with another compound, such as a compound to increase the half-life of the polypeptide (e.g., polyethylene glycol), or in which additional amino acids are fused to the mature polypeptide, such as a leader or secretory sequence or a sequence for purification of the mature polypeptide or a pro-protein sequence.

Known protein modifications include, but are not limited to, acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent crosslinks, formation of cystine, formation of pyroglutamate, formylation, gamma carboxylation, glycosylation, GPI anchor formation, hydroxylation, iodination, methylation, myristoylation, oxidation, proteolytic processing, phosphorylation, prenylation, racemization, selenoylation, sulfation, transfer-RNA mediated addition of amino acids to proteins such as arginylation, and ubiquitination.

Such protein modifications are well known to those of skill in the art and have been described in great detail in the scientific literature. Particularly common modifications, for example glycosylation, lipid attachment, sulfation, gamma-carboxylation of glutamic acid residues, hydroxylation and ADP-ribosylation, are described in most basic texts, such as *Proteins—Structure and Molecular Properties* 2nd Ed., T. E. Creighton, W.H. Freeman and Company, N.Y. (1993); F. Wold, *Posttranslational Covalent Modification of Proteins* 1-12, B. C. Johnson, ed., Academic Press, N.Y. (1983); Seifter et al., *Meth Enzymol* 182:626-646 (1990); and Rattan et al., *Ann NY Acad Sci* 663:48-62 (1992).

The present invention further provides fragments of the variant proteins in which the fragments contain one or more amino acid sequence variations (e.g., substitutions, or truncations or extensions due to creation or destruction of a stop codon) encoded by one or more SNPs disclosed herein. The fragments to which the invention pertains, however, are not to be construed as encompassing fragments that have been disclosed in the prior art before the present invention.

As used herein, a fragment may comprise at least about 4, 8, 10, 12, 14, 16, 18, 20, 25, 30, 50, 100 (or any other number in-between) or more contiguous amino acid residues from a variant protein, wherein at least one amino acid residue is affected by a SNP of the present invention, e.g., a variant amino acid residue encoded by a nonsynonymous nucleotide substitution at a cSNP position provided by the present invention. The variant amino acid encoded by a cSNP may occupy any residue position along the sequence of the fragment. Such fragments can be chosen based on the ability to retain one or more of the biological activities of the variant protein or the ability to perform a function, e.g., act as an immunogen. Particularly important fragments are biologically active fragments. Such fragments will typically comprise a domain or motif of a variant protein of the present invention, e.g., active site, transmembrane domain, or ligand/substrate binding domain. Other fragments include, but are not limited to, domain or motif-containing fragments, soluble peptide fragments, and fragments containing immunogenic structures. Predicted domains and functional sites are readily identifiable by computer programs well known to those of skill in the art (e.g., PROSITE analysis). *Current Protocols in Protein Science*, John Wiley & Sons, N.Y. (2002).

Uses of Variant Proteins

The variant proteins of the present invention can be used in a variety of ways, including but not limited to, in assays to determine the biological activity of a variant protein, such as in a panel of multiple proteins for high-throughput screening; to raise antibodies or to elicit another type of immune response; as a reagent (including the labeled reagent) in assays designed to quantitatively determine levels of the variant protein (or its binding partner) in biological fluids; as a marker for cells or tissues in which it is preferentially expressed (either constitutively or at a particular stage of tissue differentiation or development or in a disease state); as a target for screening for a therapeutic agent; and as a direct therapeutic agent to be administered into a human subject. Any of the variant proteins disclosed herein may be developed into reagent grade or kit format for commercialization as research products. Methods for performing the uses listed above are well known to those skilled in the art. See, e.g., *Molecular Cloning: A Laboratory Manual*, Sambrook and Russell, Cold Spring Harbor Laboratory Press, N.Y. (2000), and *Methods in Enzymology: Guide to Molecular Cloning Techniques*, S. L. Berger and A. R. Kimmel, eds., Academic Press (1987).

In a specific embodiment of the invention, the methods of the present invention include detection of one or more variant proteins disclosed herein. Variant proteins are disclosed in Table 1 and in the Sequence Listing as SEQ ID NOS:17-32. Detection of such proteins can be accomplished using, for example, antibodies, small molecule compounds, aptamers, ligands/substrates, other proteins or protein fragments, or other protein-binding agents. Preferably, protein detection agents are specific for a variant protein of the present invention and can therefore discriminate between a variant protein of the present invention and the wild-type protein or another variant form. This can generally be accomplished by, for example, selecting or designing detection agents that bind to the region of a protein that differs between the variant and wild-type protein, such as a region of a protein that contains one or more amino acid substitutions that is/are encoded by a non-synonymous cSNP of the present invention, or a region of a protein that follows a nonsense mutation-type SNP that creates a stop codon thereby leading to a shorter polypeptide, or a region of a protein that follows a read-through mutation-type SNP that destroys a stop codon thereby leading to a longer polypeptide in which a portion of the polypeptide is present in one version of the polypeptide but not the other.

In another specific aspect of the invention, the variant proteins of the present invention are used as targets for diagnosing or prognosing autoimmune disease or for determining predisposition to autoimmune disease in a human, for treating and/or preventing autoimmune disease, or for predicting an individual's response to TNF inhibitor treatment (particularly treatment or prevention of autoimmune disease using TNF inhibitors), etc. Accordingly, the invention provides methods for detecting the presence of, or levels of, one or more variant proteins of the present invention in a cell, tissue, or organism. Such methods typically involve contacting a test sample with an agent (e.g., an antibody, small molecule compound, or peptide) capable of interacting with the variant protein such that specific binding of the agent to the variant protein can be detected. Such an assay can be provided in a single detection format or a multi-detection format such as an array, for example, an antibody or aptamer array (arrays for protein detection may also be referred to as "protein chips"). The variant protein of interest can be isolated from a test sample and assayed for the presence of a variant amino acid sequence encoded by one or more SNPs disclosed by the present invention. The SNPs may cause changes to the protein and the corresponding protein function/activity, such as through non-synonymous substitutions in protein coding regions that can lead to amino acid substitutions, deletions, insertions, and/or rearrangements; formation or destruction of stop codons; or alteration of control elements such as promoters. SNPs may also cause inappropriate post-translational modifications.

One preferred agent for detecting a variant protein in a sample is an antibody capable of selectively binding to a variant form of the protein (antibodies are described in greater detail in the next section). Such samples include, for example, tissues, cells, and biological fluids isolated from a subject, as well as tissues, cells and fluids present within a subject.

In vitro methods for detection of the variant proteins associated with autoimmune disease that are disclosed herein and fragments thereof include, but are not limited to, enzyme linked immunosorbent assays (ELISAs), radioimmunoassays (RIA), Western blots, immunoprecipitations, immunofluorescence, and protein arrays/chips (e.g., arrays of antibodies or aptamers). For further information regarding immunoassays and related protein detection methods, see *Current Protocols in Immunology*, John Wiley & Sons, N.Y., and Hage, "Immunoassays," *Anal Chem* 15; 71(12):294R-304R (June 1999).

Additional analytic methods of detecting amino acid variants include, but are not limited to, altered electrophoretic mobility, altered tryptic peptide digest, altered protein activity in cell-based or cell-free assay, alteration in ligand or antibody-binding pattern, altered isoelectric point, and direct amino acid sequencing.

Alternatively, variant proteins can be detected in vivo in a subject by introducing into the subject a labeled antibody (or other type of detection reagent) specific for a variant protein. For example, the antibody can be labeled with a radioactive marker whose presence and location in a subject can be detected by standard imaging techniques.

Other uses of the variant peptides of the present invention are based on the class or action of the protein. For example, proteins isolated from humans and their mammalian orthologs serve as targets for identifying agents (e.g., small molecule drugs or antibodies) for use in therapeutic applications, particularly for modulating a biological or pathological response in a cell or tissue that expresses the protein. Pharmaceutical agents can be developed that modulate protein activity.

As an alternative to modulating gene expression, therapeutic compounds can be developed that modulate protein function. For example, many SNPs disclosed herein affect the amino acid sequence of the encoded protein (e.g., non-synonymous cSNPs and nonsense mutation-type SNPs). Such alterations in the encoded amino acid sequence may affect protein function, particularly if such amino acid sequence variations occur in functional protein domains, such as catalytic domains, ATP-binding domains, or ligand/substrate binding domains. It is well established in the art that variant proteins having amino acid sequence variations in functional domains can cause or influence pathological conditions. In such instances, compounds (e.g., small molecule drugs or antibodies) can be developed that target the variant protein and modulate (e.g., up- or down-regulate) protein function/activity.

The therapeutic methods of the present invention further include methods that target one or more variant proteins of the present invention. Variant proteins can be targeted using, for example, small molecule compounds, antibodies, aptamers, ligands/substrates, other proteins, or other protein-binding agents. Additionally, the skilled artisan will recognize that the novel protein variants (and polymorphic nucleic acid molecules) disclosed in Table 1 may themselves be directly used as therapeutic agents by acting as competitive inhibitors of corresponding art-known proteins (or nucleic acid molecules such as mRNA molecules).

The variant proteins of the present invention are particularly useful in drug screening assays, in cell-based or cell-free systems. Cell-based systems can utilize cells that naturally express the protein, a biopsy specimen, or cell cultures. In one embodiment, cell-based assays involve recombinant host cells expressing the variant protein. Cell-free assays can be used to detect the ability of a compound to directly bind to a variant protein or to the corresponding SNP-containing nucleic acid fragment that encodes the variant protein.

A variant protein of the present invention, as well as appropriate fragments thereof, can be used in high-throughput screening assays to test candidate compounds for the ability to bind and/or modulate the activity of the variant protein. These candidate compounds can be further screened against a protein having normal function (e.g., a wild-type/non-variant protein) to further determine the effect of the compound on the protein activity. Furthermore, these compounds can be tested in animal or invertebrate systems to determine in vivo activity/effectiveness. Compounds can be identified that activate (agonists) or inactivate (antagonists) the variant protein, and different compounds can be identified that cause various degrees of activation or inactivation of the variant protein.

Further, the variant proteins can be used to screen a compound for the ability to stimulate or inhibit interaction between the variant protein and a target molecule that normally interacts with the protein. The target can be a ligand, a substrate or a binding partner that the protein normally interacts with (for example, epinephrine or norepinephrine). Such assays typically include the steps of combining the variant protein with a candidate compound under conditions that allow the variant protein, or fragment thereof, to interact with the target molecule, and to detect the formation of a complex between the protein and the target or to detect the biochemical consequence of the interaction with the variant protein and the target, such as any of the associated effects of signal transduction.

Candidate compounds include, for example, 1) peptides such as soluble peptides, including Ig-tailed fusion peptides and members of random peptide libraries (see, e.g., Lam et al., Nature 354:82-84 (1991); Houghten et al., Nature 354:84-86 (1991)) and combinatorial chemistry-derived molecular libraries made of D- and/or L-configuration amino acids; 2) phosphopeptides (e.g., members of random and partially degenerate, directed phosphopeptide libraries, see, e.g. Songyang et al., Cell 72:767-778 (1993)); 3) antibodies (e.g., polyclonal, monoclonal, humanized, anti-idiotypic, chimeric, and single chain antibodies as well as Fab, $F(ab')_2$, Fab expression library fragments, and epitope-binding fragments of antibodies); and 4) small organic and inorganic molecules (e.g., molecules obtained from combinatorial and natural product libraries).

One candidate compound is a soluble fragment of the variant protein that competes for ligand binding. Other candidate compounds include mutant proteins or appropriate fragments containing mutations that affect variant protein function and thus compete for ligand. Accordingly, a fragment that competes for ligand, for example with a higher affinity, or a fragment that binds ligand but does not allow release, is encompassed by the invention.

The invention further includes other end point assays to identify compounds that modulate (stimulate or inhibit) variant protein activity. The assays typically involve an assay of events in the signal transduction pathway that indicate protein activity. Thus, the expression of genes that are up or down-regulated in response to the variant protein dependent signal cascade can be assayed. In one embodiment, the regulatory region of such genes can be operably linked to a marker that is easily detectable, such as luciferase. Alternatively, phosphorylation of the variant protein, or a variant protein target, could also be measured. Any of the biological or biochemical functions mediated by the variant protein can be used as an endpoint assay. These include all of the biochemical or biological events described herein, in the references cited herein, incorporated by reference for these endpoint assay targets, and other functions known to those of ordinary skill in the art.

Binding and/or activating compounds can also be screened by using chimeric variant proteins in which an amino terminal extracellular domain or parts thereof, an entire transmembrane domain or subregions, and/or the carboxyl terminal intracellular domain or parts thereof, can be replaced by heterologous domains or subregions. For example, a substrate-binding region can be used that interacts with a different substrate than that which is normally recognized by a variant protein. Accordingly, a different set of signal transduction components is available as an end-point assay for activation. This allows for assays to be performed in other than the specific host cell from which the variant protein is derived.

The variant proteins are also useful in competition binding assays in methods designed to discover compounds that interact with the variant protein. Thus, a compound can be exposed to a variant protein under conditions that allow the compound to bind or to otherwise interact with the variant protein. A binding partner, such as ligand, that normally interacts with the variant protein is also added to the mixture. If the test compound interacts with the variant protein or its binding partner, it decreases the amount of complex formed or activity from the variant protein. This type of assay is particularly useful in screening for compounds that interact with specific regions of the variant protein. Hodgson, *Bio/technology*, 10(9), 973-80 (September 1992).

To perform cell-free drug screening assays, it is sometimes desirable to immobilize either the variant protein or a fragment thereof, or its target molecule, to facilitate separation of complexes from uncomplexed forms of one or both of the proteins, as well as to accommodate automation of the assay. Any method for immobilizing proteins on matrices can be used in drug screening assays. In one embodiment, a fusion protein containing an added domain allows the protein to be bound to a matrix. For example, glutathione-S-transferase/$^{125}$I fusion proteins can be adsorbed onto glutathione sepharose beads (Sigma Chemical, St. Louis, Mo.) or glutathione derivatized microtitre plates, which are then combined with the cell lysates (e.g., $^{35}$S-labeled) and a candidate compound, such as a drug candidate, and the mixture incubated under conditions conducive to complex formation (e.g., at physiological conditions for salt and pH). Following incubation, the beads can be washed to remove any unbound label, and the matrix immobilized and radiolabel determined directly, or in the supernatant after the complexes are dissociated. Alternatively, the complexes can be dissociated from the matrix, separated by SDS-PAGE, and the level of bound material found in the bead fraction quantitated from the gel using standard electrophoretic techniques.

Either the variant protein or its target molecule can be immobilized utilizing conjugation of biotin and streptavidin. Alternatively, antibodies reactive with the variant protein but which do not interfere with binding of the variant protein to its target molecule can be derivatized to the wells of the plate, and the variant protein trapped in the wells by antibody conjugation. Preparations of the target molecule and a candidate compound are incubated in the variant protein-presenting wells and the amount of complex trapped in the well can be quantitated. Methods for detecting such complexes, in addition to those described above for the GST-immobilized complexes, include immunodetection of complexes using antibodies reactive with the protein target molecule, or which are reactive with variant protein and compete with the target molecule, and enzyme-linked assays that rely on detecting an enzymatic activity associated with the target molecule.

Modulators of variant protein activity identified according to these drug screening assays can be used to treat a subject with a disorder mediated by the protein pathway, such as autoimmune disease. These methods of treatment typically include the steps of administering the modulators of protein activity in a pharmaceutical composition to a subject in need of such treatment.

The variant proteins, or fragments thereof, disclosed herein can themselves be directly used to treat a disorder characterized by an absence of, inappropriate, or unwanted expression or activity of the variant protein. Accordingly, methods for treatment include the use of a variant protein disclosed herein or fragments thereof.

In yet another aspect of the invention, variant proteins can be used as "bait proteins" in a two-hybrid assay or three-hybrid assay to identify other proteins that bind to or interact with the variant protein and are involved in variant protein activity. See, e.g., U.S. Pat. No. 5,283,317; Zervos et al., *Cell* 72:223-232 (1993); Madura et al., *J Biol Chem* 268:12046-12054 (1993); Bartel et al., *Biotechniques* 14:920-924 (1993); Iwabuchi et al., *Oncogene* 8:1693-1696 (1993); and Brent, WO 94/10300. Such variant protein-binding proteins are also likely to be involved in the propagation of signals by the variant proteins or variant protein targets as, for example, elements of a protein-mediated signaling pathway. Alternatively, such variant protein-binding proteins are inhibitors of the variant protein.

The two-hybrid system is based on the modular nature of most transcription factors, which typically consist of separable DNA-binding and activation domains. Briefly, the assay typically utilizes two different DNA constructs. In one construct, the gene that codes for a variant protein is fused to a gene encoding the DNA binding domain of a known transcription factor (e.g., GAL-4). In the other construct, a DNA sequence, from a library of DNA sequences, that encodes an unidentified protein ("prey" or "sample") is fused to a gene that codes for the activation domain of the known transcription factor. If the "bait" and the "prey" proteins are able to interact, in vivo, forming a variant protein-dependent complex, the DNA-binding and activation domains of the transcription factor are brought into close proximity. This proximity allows transcription of a reporter gene (e.g., LacZ) that is operably linked to a transcriptional regulatory site responsive to the transcription factor. Expression of the reporter gene can be detected, and cell colonies containing the functional transcription factor can be isolated and used to obtain the cloned gene that encodes the protein that interacts with the variant protein.

Antibodies Directed to Variant Proteins

The present invention also provides antibodies that selectively bind to the variant proteins disclosed herein and fragments thereof. Such antibodies may be used to quantitatively or qualitatively detect the variant proteins of the present invention. As used herein, an antibody selectively binds a target variant protein when it binds the variant protein and does not significantly bind to non-variant proteins, i.e., the antibody does not significantly bind to normal, wild-type, or art-known proteins that do not contain a variant amino acid sequence due to one or more SNPs of the present invention (variant amino acid sequences may be due to, for example, nonsynonymous cSNPs, nonsense SNPs that create a stop codon, thereby causing a truncation of a polypeptide or SNPs that cause read-through mutations resulting in an extension of a polypeptide).

As used herein, an antibody is defined in terms consistent with that recognized in the art: they are multi-subunit proteins produced by an organism in response to an antigen challenge. The antibodies of the present invention include both monoclonal antibodies and polyclonal antibodies, as well as antigen-reactive proteolytic fragments of such antibodies, such as Fab, F(ab)'$_2$, and Fv fragments. In addition, an antibody of the present invention further includes any of a variety of engineered antigen-binding molecules such as a chimeric antibody (U.S. Pat. Nos. 4,816,567 and 4,816,397; Morrison et al., *Proc Natl Acad Sci USA* 81:6851 (1984); Neuberger et al., *Nature* 312:604 (1984)), a humanized antibody (U.S. Pat. Nos. 5,693,762; 5,585,089 and 5,565,332), a single-chain Fv (U.S. Pat. No. 4,946,778; Ward et al., *Nature* 334:544 (1989)), a bispecific antibody with two binding specificities (Segal et al., *J Immunol Methods* 248:1 (2001); Carter, *J Immunol Methods* 248:7 (2001)), a diabody, a triabody, and a tetrabody (Todorovska et al., *J Immunol Methods* 248:47 (2001)), as well as a Fab conjugate (dimer or trimer), and a minibody.

Many methods are known in the art for generating and/or identifying antibodies to a given target antigen. Harlow, *Antibodies*, Cold Spring Harbor Press, N.Y. (1989). In general, an isolated peptide (e.g., a variant protein of the present invention) is used as an immunogen and is administered to a mammalian organism, such as a rat, rabbit, hamster or mouse. Either a full-length protein, an antigenic peptide fragment (e.g., a peptide fragment containing a region that varies between a variant protein and a corresponding wild-type protein), or a fusion protein can be used. A protein used as an immunogen may be naturally-occurring, synthetic or recombinantly produced, and may be administered in combination with an adjuvant, including but not limited to, Freund's (complete and incomplete), mineral gels such as aluminum hydroxide, surface active substance such as lysolecithin, pluronic polyols, polyanions, peptides, oil emulsions, keyhole limpet hemocyanin, dinitrophenol, and the like.

Monoclonal antibodies can be produced by hybridoma technology, which immortalizes cells secreting a specific monoclonal antibody. Kohler and Milstein, *Nature* 256:495 (1975). The immortalized cell lines can be created in vitro by fusing two different cell types, typically lymphocytes, and tumor cells. The hybridoma cells may be cultivated in vitro or in vivo. Additionally, fully human antibodies can be generated by transgenic animals. He et al., *J Immunol* 169:595 (2002). Fd phage and Fd phagemid technologies may be used to generate and select recombinant antibodies in vitro. Hoogenboom and Chames, *Immunol Today* 21:371 (2000); Liu et al., *J Mol Biol* 315:1063 (2002). The complementarity-determining regions of an antibody can be identified, and synthetic peptides corresponding to such regions may be used to mediate antigen binding. U.S. Pat. No. 5,637,677.

Antibodies are preferably prepared against regions or discrete fragments of a variant protein containing a variant amino acid sequence as compared to the corresponding wild-type protein (e.g., a region of a variant protein that includes an amino acid encoded by a nonsynonymous cSNP, a region affected by truncation caused by a nonsense SNP that creates a stop codon, or a region resulting from the destruction of a stop codon due to read-through mutation caused by a SNP). Furthermore, preferred regions will include those involved in function/activity and/or protein/binding partner interaction. Such fragments can be selected on a physical property, such as fragments corresponding to regions that are located on the surface of the protein, e.g., hydrophilic regions, or can be selected based on sequence uniqueness, or based on the position of the variant amino acid residue(s) encoded by the SNPs provided by the present invention. An antigenic fragment will typically comprise at least about 8-10 contiguous amino acid residues in which at least one of the amino acid residues is an amino acid affected by a SNP disclosed herein. The antigenic peptide can comprise, however, at least 12, 14, 16, 20, 25, 50, 100 (or any other number in-between) or more amino acid residues, provided that at least one amino acid is affected by a SNP disclosed herein.

Detection of an antibody of the present invention can be facilitated by coupling (i.e., physically linking) the antibody or an antigen-reactive fragment thereof to a detectable substance. Detectable substances include, but are not limited to, various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}$I, $^{131}$I, $^{35}$S or $^{3}$H.

Antibodies, particularly the use of antibodies as therapeutic agents, are reviewed in: Morgan, "Antibody therapy for Alzheimer's disease," *Expert Rev Vaccines* (1):53-9 (February 2003); Ross et al., "Anticancer antibodies," *Am J Clin Pathol* 119(4):472-85 (April 2003); Goldenberg, "Advancing role of radiolabeled antibodies in the therapy of cancer," *Cancer Immunol Immunother* 52(5):281-96 (May 2003); Epub Mar. 11, 2003; Ross et al., "Antibody-based therapeutics in oncology," *Expert Rev Anticancer Ther* 3(1):107-21 (February 2003); Cao et al., "Bispecific antibody conjugates in therapeutics," *Adv Drug Deliv Rev* 55(2):171-97 (February 2003); von Mehren et al., "Monoclonal antibody therapy for cancer," *Annu Rev Med* 54:343-69 (2003); Epub Dec. 3, 2001; Hudson et al., "Engineered antibodies," *Nat Med* 9(1):129-34 (January 2003); Brekke et al., "Therapeutic antibodies for human diseases at the dawn of the twenty-first century," *Nat Rev Drug Discov* 2(1):52-62 (January 2003); Erratum in: *Nat Rev Drug Discov* 2(3):240 (March 2003); Houdebine, "Antibody manufacture in transgenic animals and comparisons with other systems," *Curr Opin Biotechnol* 13(6):625-9 (December 2002); Andreakos et al., "Monoclonal antibodies in immune and inflammatory diseases," *Curr Opin Biotechnol* 13(6):615-20 (December 2002); Kellermann et al., "Antibody discovery: the use of transgenic mice to generate human monoclonal antibodies for therapeutics," *Curr Opin Biotechnol* 13(6):593-7 (December 2002); Pini et al., "Phage display and colony filter screening for high-throughput selection of antibody libraries," *Comb Chem High Throughput Screen* 5(7):503-10 (November 2002); Batra et al., "Pharmacokinetics and biodistribution of genetically engineered antibodies," *Curr Opin Biotechnol* 13(6):603-8 (December 2002); and Tangri et al., "Rationally engineered proteins or antibodies with absent or reduced immunogenicity," *Curr Med Chem* 9(24):2191-9 (December 2002).

Uses of Antibodies

Antibodies can be used to isolate the variant proteins of the present invention from a natural cell source or from recombinant host cells by standard techniques, such as affinity chromatography or immunoprecipitation. In addition, antibodies are useful for detecting the presence of a variant protein of the present invention in cells or tissues to determine the pattern of expression of the variant protein among various tissues in an organism and over the course of normal development or disease progression. Further, antibodies can be used to detect variant protein in situ, in vitro, in a bodily fluid, or in a cell lysate or supernatant in order to evaluate the amount and pattern of expression. Also, antibodies can be used to assess abnormal tissue distribution, abnormal expression during development, or expression in an abnormal condition, such as in autoimmune disease, or during TNF inhibitor treatment. Additionally, antibody detection of circulating fragments of the full-length variant protein can be used to identify turnover.

Antibodies to the variant proteins of the present invention are also useful in pharmacogenomic analysis. Thus, antibodies against variant proteins encoded by alternative SNP alleles can be used to identify individuals that require modified treatment modalities.

Further, antibodies can be used to assess expression of the variant protein in disease states such as in active stages of the disease or in an individual with a predisposition to a disease related to the protein's function, such as autoimmune disease, or during the course of a treatment regime, such as during TNF inhibitor treatment. Antibodies specific for a variant protein encoded by a SNP-containing nucleic acid molecule of the present invention can be used to assay for the presence of the variant protein, such as to diagnose or prognose autoimmune disease or to predict an individual's response to TNF inhibitor treatment or predisposition/susceptibility to autoimmune disease, as indicated by the presence of the variant protein.

Antibodies are also useful as diagnostic tools for evaluating the variant proteins in conjunction with analysis by electrophoretic mobility, isoelectric point, tryptic peptide digest, and other physical assays well known in the art.

Antibodies are also useful for tissue typing. Thus, where a specific variant protein has been correlated with expression in a specific tissue, antibodies that are specific for this protein can be used to identify a tissue type.

Antibodies can also be used to assess aberrant subcellular localization of a variant protein in cells in various tissues. The diagnostic uses can be applied, not only in genetic testing, but also in monitoring a treatment modality. Accordingly, where treatment is ultimately aimed at correcting the expression level or the presence of variant protein or aberrant tissue distribution or developmental expression of a variant protein, antibodies directed against the variant protein or relevant fragments can be used to monitor therapeutic efficacy.

The antibodies are also useful for inhibiting variant protein function, for example, by blocking the binding of a variant protein to a binding partner. These uses can also be applied in a therapeutic context in which treatment involves inhibiting a variant protein's function. An antibody can be used, for example, to block or competitively inhibit binding, thus modulating (agonizing or antagonizing) the activity of a variant protein. Antibodies can be prepared against specific variant protein fragments containing sites required for function or against an intact variant protein that is associated with a cell or cell membrane. For in vivo administration, an antibody may be linked with an additional therapeutic payload such as a radionuclide, an enzyme, an immunogenic epitope, or a cytotoxic agent. Suitable cytotoxic agents include, but are not limited to, bacterial toxin such as diphtheria, and plant toxin such as ricin. The in vivo half-life of an antibody or a fragment thereof may be lengthened by pegylation through conjugation to polyethylene glycol. Leong et al., *Cytokine* 16:106 (2001).

The invention also encompasses kits for using antibodies, such as kits for detecting the presence of a variant protein in a test sample. An exemplary kit can comprise antibodies such as a labeled or labelable antibody and a compound or agent for detecting variant proteins in a biological sample; means for determining the amount, or presence/absence of variant protein in the sample; means for comparing the amount of variant protein in the sample with a standard; and instructions for use.

Vectors and Host Cells

The present invention also provides vectors containing the SNP-containing nucleic acid molecules described herein. The term "vector" refers to a vehicle, preferably a nucleic acid molecule, which can transport a SNP-containing nucleic acid molecule. When the vector is a nucleic acid molecule, the SNP-containing nucleic acid molecule can be covalently linked to the vector nucleic acid. Such vectors include, but are not limited to, a plasmid, single or double stranded phage, a single or double stranded RNA or DNA viral vector, or artificial chromosome, such as a BAC, PAC, YAC, or MAC.

A vector can be maintained in a host cell as an extrachromosomal element where it replicates and produces additional copies of the SNP-containing nucleic acid molecules. Alternatively, the vector may integrate into the host cell genome and produce additional copies of the SNP-containing nucleic acid molecules when the host cell replicates.

The invention provides vectors for the maintenance (cloning vectors) or vectors for expression (expression vectors) of the SNP-containing nucleic acid molecules. The vectors can function in prokaryotic or eukaryotic cells or in both (shuttle vectors).

Expression vectors typically contain cis-acting regulatory regions that are operably linked in the vector to the SNP-containing nucleic acid molecules such that transcription of the SNP-containing nucleic acid molecules is allowed in a host cell. The SNP-containing nucleic acid molecules can also be introduced into the host cell with a separate nucleic acid molecule capable of affecting transcription. Thus, the second nucleic acid molecule may provide a trans-acting factor interacting with the cis-regulatory control region to allow transcription of the SNP-containing nucleic acid molecules from the vector. Alternatively, a trans-acting factor may be supplied by the host cell. Finally, a trans-acting factor can be produced from the vector itself. It is understood, however, that in some embodiments, transcription and/or translation of the nucleic acid molecules can occur in a cell-free system.

The regulatory sequences to which the SNP-containing nucleic acid molecules described herein can be operably linked include promoters for directing mRNA transcription. These include, but are not limited to, the left promoter from bacteriophage λ, the lac, TRP, and TAC promoters from *E. coli*, the early and late promoters from SV40, the CMV immediate early promoter, the adenovirus early and late promoters, and retrovirus long-terminal repeats.

In addition to control regions that promote transcription, expression vectors may also include regions that modulate transcription, such as repressor binding sites and enhancers. Examples include the SV40 enhancer, the cytomegalovirus immediate early enhancer, polyoma enhancer, adenovirus enhancers, and retrovirus LTR enhancers.

In addition to containing sites for transcription initiation and control, expression vectors can also contain sequences necessary for transcription termination and, in the transcribed region, a ribosome-binding site for translation. Other regulatory control elements for expression include initiation and termination codons as well as polyadenylation signals. A person of ordinary skill in the art would be aware of the numerous regulatory sequences that are useful in expression vectors. See, e.g., Sambrook and Russell, *Molecular Cloning: A Laboratory Manual*, Cold Spring Harbor Laboratory Press, N.Y. (2000).

A variety of expression vectors can be used to express a SNP-containing nucleic acid molecule. Such vectors include chromosomal, episomal, and virus-derived vectors, for example, vectors derived from bacterial plasmids, from bacteriophage, from yeast episomes, from yeast chromosomal elements, including yeast artificial chromosomes, from viruses such as baculoviruses, papovaviruses such as SV40, Vaccinia viruses, adenoviruses, poxviruses, pseudorabies viruses, and retroviruses. Vectors can also be derived from combinations of these sources such as those derived from plasmid and bacteriophage genetic elements, e.g., cosmids and phagemids. Appropriate cloning and expression vectors for prokaryotic and eukaryotic hosts are described in Sambrook and Russell, *Molecular Cloning: A Laboratory Manual*, Cold Spring Harbor Laboratory Press, N.Y. (2000).

The regulatory sequence in a vector may provide constitutive expression in one or more host cells (e.g., tissue specific expression) or may provide for inducible expression in one or more cell types such as by temperature, nutrient additive, or exogenous factor, e.g., a hormone or other ligand. A variety of vectors that provide constitutive or inducible expression of a nucleic acid sequence in prokaryotic and eukaryotic host cells are well known to those of ordinary skill in the art.

A SNP-containing nucleic acid molecule can be inserted into the vector by methodology well-known in the art. Generally, the SNP-containing nucleic acid molecule that will ultimately be expressed is joined to an expression vector by cleaving the SNP-containing nucleic acid molecule and the expression vector with one or more restriction enzymes and then ligating the fragments together. Procedures for restriction enzyme digestion and ligation are well known to those of ordinary skill in the art.

The vector containing the appropriate nucleic acid molecule can be introduced into an appropriate host cell for propagation or expression using well-known techniques. Bacterial host cells include, but are not limited to, *Escherichia coli, Streptomyces* spp., and *Salmonella typhimurium*. Eukaryotic host cells include, but are not limited to, yeast, insect cells such as *Drosophila* spp., animal cells such as COS and CHO cells, and plant cells.

As described herein, it may be desirable to express the variant peptide as a fusion protein. Accordingly, the invention provides fusion vectors that allow for the production of the variant peptides. Fusion vectors can, for example, increase the expression of a recombinant protein, increase the solubility of the recombinant protein, and aid in the purification of the protein by acting, for example, as a ligand for affinity purification. A proteolytic cleavage site may be introduced at the junction of the fusion moiety so that the desired variant peptide can ultimately be separated from the fusion moiety. Proteolytic enzymes suitable for such use include, but are not limited to, factor Xa, thrombin, and enterokinase. Typical fusion expression vectors include pGEX (Smith et al., *Gene* 67:31-40 (1988)), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein. Examples of suitable inducible non-fusion *E. coli* expression vectors include pTrc (Amann et al., *Gene* 69:301-315 (1988)) and pET 11d (Studier et al., *Gene Expression Technology: Methods in Enzymology* 185:60-89 (1990)).

Recombinant protein expression can be maximized in a bacterial host by providing a genetic background wherein the host cell has an impaired capacity to proteolytically cleave the recombinant protein (S. Gottesman, *Gene Expression Technology: Methods in Enzymology* 185:119-128, Academic Press, Calif. (1990)). Alternatively, the sequence of the SNP-containing nucleic acid molecule of interest can be altered to provide preferential codon usage for a specific host cell, for example, *E. coli*. Wada et al., *Nucleic Acids Res* 20:2111-2118 (1992).

The SNP-containing nucleic acid molecules can also be expressed by expression vectors that are operative in yeast. Examples of vectors for expression in yeast (e.g., *S. cerevisiae*) include pYepSec1 (Baldari et al., *EMBO J.* 6:229-234 (1987)), pMFa (Kujan et al., *Cell* 30:933-943 (1982)), pJRY88 (Schultz et al., *Gene* 54:113-123 (1987)), and pYES2 (Invitrogen Corporation, San Diego, Calif.).

The SNP-containing nucleic acid molecules can also be expressed in insect cells using, for example, baculovirus expression vectors. Baculovirus vectors available for expression of proteins in cultured insect cells (e.g., Sf 9 cells) include the pAc series (Smith et al., *Mol Cell Biol* 3:2156-2165 (1983)) and the pVL series (Lucklow et al., *Virology* 170:31-39 (1989)).

In certain embodiments of the invention, the SNP-containing nucleic acid molecules described herein are expressed in mammalian cells using mammalian expression vectors. Examples of mammalian expression vectors include pCDM8 (B. Seed, *Nature* 329:840 (1987)) and pMT2PC (Kaufman et al., *EMBO J* 6:187-195 (1987)).

The invention also encompasses vectors in which the SNP-containing nucleic acid molecules described herein are cloned into the vector in reverse orientation, but operably linked to a regulatory sequence that permits transcription of antisense RNA. Thus, an antisense transcript can be produced to the SNP-containing nucleic acid sequences described herein, including both coding and non-coding regions. Expression of this antisense RNA is subject to each of the parameters described above in relation to expression of the sense RNA (regulatory sequences, constitutive or inducible expression, tissue-specific expression).

The invention also relates to recombinant host cells containing the vectors described herein. Host cells therefore include, for example, prokaryotic cells, lower eukaryotic cells such as yeast, other eukaryotic cells such as insect cells, and higher eukaryotic cells such as mammalian cells.

The recombinant host cells can be prepared by introducing the vector constructs described herein into the cells by techniques readily available to persons of ordinary skill in the art. These include, but are not limited to, calcium phosphate transfection, DEAE-dextran-mediated transfection, cationic lipid-mediated transfection, electroporation, transduction, infection, lipofection, and other techniques such as those described in Sambrook and Russell, *Molecular Cloning: A Laboratory Manual*, Cold Spring Harbor Laboratory, Cold Spring Harbor Laboratory Press, N.Y. (2000).

Host cells can contain more than one vector. Thus, different SNP-containing nucleotide sequences can be introduced in different vectors into the same cell. Similarly, the SNP-containing nucleic acid molecules can be introduced either alone or with other nucleic acid molecules that are not related to the SNP-containing nucleic acid molecules, such as those providing trans-acting factors for expression vectors. When more than one vector is introduced into a cell, the vectors can be introduced independently, co-introduced, or joined to the nucleic acid molecule vector.

In the case of bacteriophage and viral vectors, these can be introduced into cells as packaged or encapsulated virus by standard procedures for infection and transduction. Viral vectors can be replication-competent or replication-defective. In the case in which viral replication is defective, replication can occur in host cells that provide functions that complement the defects.

Vectors generally include selectable markers that enable the selection of the subpopulation of cells that contain the recombinant vector constructs. The marker can be inserted in the same vector that contains the SNP-containing nucleic acid molecules described herein or may be in a separate vector. Markers include, for example, tetracycline or ampicillin-resistance genes for prokaryotic host cells, and dihydrofolate reductase or neomycin resistance genes for eukaryotic host cells. However, any marker that provides selection for a phenotypic trait can be effective.

While the mature variant proteins can be produced in bacteria, yeast, mammalian cells, and other cells under the control of the appropriate regulatory sequences, cell-free transcription and translation systems can also be used to produce these variant proteins using RNA derived from the DNA constructs described herein.

Where secretion of the variant protein is desired, which is difficult to achieve with multi-transmembrane domain containing proteins such as G-protein-coupled receptors (GPCRs), appropriate secretion signals can be incorporated into the vector. The signal sequence can be endogenous to the peptides or heterologous to these peptides.

Where the variant protein is not secreted into the medium, the protein can be isolated from the host cell by standard disruption procedures, including freeze/thaw, sonication, mechanical disruption, use of lysing agents, and the like. The variant protein can then be recovered and purified by well-known purification methods including, for example, ammonium sulfate precipitation, acid extraction, anion or cationic exchange chromatography, phosphocellulose chromatography, hydrophobic-interaction chromatography, affinity chromatography, hydroxylapatite chromatography, lectin chromatography, or high performance liquid chromatography.

It is also understood that, depending upon the host cell in which recombinant production of the variant proteins described herein occurs, they can have various glycosylation patterns, or may be non-glycosylated, as when produced in bacteria. In addition, the variant proteins may include an initial modified methionine in some cases as a result of a host-mediated process.

For further information regarding vectors and host cells, see Current Protocols in Molecular Biology, John Wiley & Sons, N.Y.

Uses of Vectors and Host Cells, and Transgenic Animals

Recombinant host cells that express the variant proteins described herein have a variety of uses. For example, the cells are useful for producing a variant protein that can be further purified into a preparation of desired amounts of the variant protein or fragments thereof. Thus, host cells containing expression vectors are useful for variant protein production.

Host cells are also useful for conducting cell-based assays involving the variant protein or variant protein fragments, such as those described above as well as other formats known in the art. Thus, a recombinant host cell expressing a variant protein is useful for assaying compounds that stimulate or inhibit variant protein function. Such an ability of a compound to modulate variant protein function may not be apparent from assays of the compound on the native/wild-type protein, or from cell-free assays of the compound. Recombinant host cells are also useful for assaying functional alterations in the variant proteins as compared with a known function.

Genetically-engineered host cells can be further used to produce non-human transgenic animals. A transgenic animal is preferably a non-human mammal, for example, a rodent, such as a rat or mouse, in which one or more of the cells of the animal include a transgene. A transgene is exogenous DNA containing a SNP of the present invention which is integrated into the genome of a cell from which a transgenic animal develops and which remains in the genome of the mature animal in one or more of its cell types or tissues. Such animals are useful for studying the function of a variant protein in vivo, and identifying and evaluating modulators of variant protein activity. Other examples of transgenic animals include, but are not limited to, non-human primates, sheep, dogs, cows, goats, chickens, and amphibians. Transgenic non-human mammals such as cows and goats can be used to produce variant proteins which can be secreted in the animal's milk and then recovered.

A transgenic animal can be produced by introducing a SNP-containing nucleic acid molecule into the male pronuclei of a fertilized oocyte, e.g., by microinjection or retroviral infection, and allowing the oocyte to develop in a pseudopregnant female foster animal. Any nucleic acid molecules that contain one or more SNPs of the present invention can potentially be introduced as a transgene into the genome of a non-human animal.

Any of the regulatory or other sequences useful in expression vectors can form part of the transgenic sequence. This includes intronic sequences and polyadenylation signals, if not already included. A tissue-specific regulatory sequence(s) can be operably linked to the transgene to direct expression of the variant protein in particular cells or tissues.

Methods for generating transgenic animals via embryo manipulation and microinjection, particularly animals such as mice, have become conventional in the art and are described, for example, in U.S. Pat. Nos. 4,736,866 and 4,870,009, both by Leder et al.; U.S. Pat. No. 4,873,191 by Wagner et al., and in B. Hogan, Manipulating the Mouse Embryo, Cold Spring Harbor Laboratory Press, N.Y. (1986). Similar methods are used for production of other transgenic animals. A transgenic founder animal can be identified based upon the presence of the transgene in its genome and/or expression of transgenic mRNA in tissues or cells of the animals. A transgenic founder animal can then be used to breed additional animals carrying the transgene. Moreover, transgenic animals carrying a transgene can further be bred to other transgenic animals carrying other transgenes. A transgenic animal also includes a non-human animal in which the entire animal or tissues in the animal have been produced using the homologously recombinant host cells described herein.

In another embodiment, transgenic non-human animals can be produced which contain selected systems that allow for regulated expression of the transgene. One example of such a system is the cre/loxP recombinase system of bacteriophage P1. Lakso et al., PNAS 89:6232-6236 (1992). Another example of a recombinase system is the FLP recombinase system of S. cerevisiae. O'Gorman et al., Science 251:1351-1355 (1991). If a cre/loxP recombinase system is used to regulate expression of the transgene, animals containing transgenes encoding both the Cre recombinase and a selected protein are generally needed. Such animals can be provided through the construction of "double" transgenic animals, e.g., by mating two transgenic animals, one containing a transgene encoding a selected variant protein and the other containing a transgene encoding a recombinase.

Clones of the non-human transgenic animals described herein can also be produced according to the methods described, for example, in I. Wilmut et al., Nature 385:810-813 (1997) and PCT International Publication Nos. WO 97/07668 and WO 97/07669. In brief, a cell (e.g., a somatic cell) from the transgenic animal can be isolated and induced to exit the growth cycle and enter $G_o$ phase. The quiescent cell can then be fused, e.g., through the use of electrical pulses, to an enucleated oocyte from an animal of the same species from which the quiescent cell is isolated. The reconstructed oocyte is then cultured such that it develops to morula or blastocyst and then transferred to pseudopregnant female foster animal. The offspring born of this female foster animal will be a clone of the animal from which the cell (e.g., a somatic cell) is isolated.

Transgenic animals containing recombinant cells that express the variant proteins described herein are useful for conducting the assays described herein in an in vivo context. Accordingly, the various physiological factors that are present in vivo and that could influence ligand or substrate binding, variant protein activation, signal transduction, or other processes or interactions, may not be evident from in vitro cell-free or cell-based assays. Thus, non-human transgenic animals of the present invention may be used to assay in vivo variant protein function as well as the activities of a therapeutic agent or compound that modulates variant protein function/activity or expression. Such animals are also suitable for assessing the effects of null mutations (i.e., mutations that substantially or completely eliminate one or more variant protein functions).

For further information regarding transgenic animals, see Houdebine, "Antibody manufacture in transgenic animals and comparisons with other systems," *Curr Opin Biotechnol* 13(6):625-9 (December 2002); Petters et al., "Transgenic animals as models for human disease," *Transgenic Res* 9(4-5):347-51, discussion 345-6 (2000); Wolf et al., "Use of transgenic animals in understanding molecular mechanisms of toxicity," *J Pharm Pharmacol* 50(6):567-74 (June 1998); Echelard, "Recombinant protein production in transgenic animals," *Curr Opin Biotechnol* 7(5):536-40 (October 1996); Houdebine, "Transgenic animal bioreactors," *Transgenic Res* 9(4-5):305-20 (2000); Pirity et al., "Embryonic stem cells, creating transgenic animals," *Methods Cell Biol* 57:279-93 (1998); and Robl et al., "Artificial chromosome vectors and expression of complex proteins in transgenic animals," *Theriogenology* 59(1):107-13 (January 2003).

EXAMPLES

The following examples are offered to illustrate, but not limit, the claimed invention.

Example 1

Analysis of SNPs Associated with Rheumatoid Arthritis Overview

A multi-tiered, case-control association study was carried out in which 25,966 putative functional SNPs were genotyped in 475 white North American RA patients and 475 matched controls. Significant markers were genotyped in two additional, independent, white case-control sample sets (661 cases/1322 controls from North America and 596 cases/705 controls from The Netherlands). A SNP, rs1953126, on chromosome 9q33.2 was identified that was significantly associated with RA ($OR_{common}$=1.28, trend $P_{comb}$=1.45E-06). Through a comprehensive fine-scale-mapping SNP-selection procedure, 137 additional SNPs in a 668 kb region from MEGF9 to STOM on 9q33.2 were chosen for follow-up genotyping in a staged-approach. Significant single marker results ($P_{comb}$<0.01) spanned a large 525 kb region from FBXW2 to GSN. However, a variety of analyses identified SNPs in a 70 kb region extending from the 5' end of PHF19 across TRAF1 into the TRAF1-C5 intergenic region, but excluding the C5 coding region, as the most significant (trend $P_{comb}$: 1.45E-06→5.41E-09). The observed association patterns for these SNPs had heightened statistical significance and a higher degree of consistency across sample sets. In addition, the allele frequencies for these SNPs displayed reduced variability between control groups when compared to other SNPs. Furthermore, in combination with the other two known genetic risk factors, HLA-DRB1 and PTPN22, the variants reported here generate more than a 45-fold RA-risk differential.

Thus, variants in the PHF19-TRAF1-C5 region on chromosome 9q33.2 are disclosed herein that show strong and consistent association across three independent RA case-control studies (1732 cases/2502 controls). Combining genetic information from HLA, PTPN22 and TRAF1 variants, the posterior probability of RA was calculated for every possible genotype combination. These variants have utilities for such uses as individualized prognosis and targeted medicine.

See Chang et al., "A large-scale rheumatoid arthritis genetic study identifies association at chromosome 9q33.2", *PLoS Genet*. 2008 Jun. 27; 4(6):e1000107, incorporated herein by reference in its entirety.

Results

Identification of the RA-associated Chr9q33.2-Region

Three sequential case-control studies were conducted to identify SNPs associated with RA. In the first study, DNA samples from white North Americans with (N=475 cases) and without (N=475 controls) RA (sample set 1, see Table 8 for a breakdown of the clinical characteristics of each sample set) were genotyped for a set of 25,966 gene-centric SNPs utilizing disease-phenotype-based pooled DNA samples (pooled DNA samples were used to increase genotyping throughput while minimizing DNA consumption). The allele frequency of each SNP was determined in cases and controls as described in the "Materials and Methods" section of Example 1 below and 1438 SNPs were significantly associated with RA using an allelic test (P<0.05); 88 of these SNPs mapped to chr 6p21 between HLA-F and HLA-DPB1 within the major histocompatibility complex (MHC). Of the 1350 non-MHC SNPs, 1306 were evaluated in a second independent white North American sample set (661 cases and 1322 controls) by use of a similar pooling strategy (44 SNPs were not genotyped due to insufficient primer quantities). Eighty-nine statistically compelling SNPs ($P_{allelic}$<0.05) with the same risk allele in these two sample sets were then individually genotyped in sample set 1 to verify the results from the pooled DNA phase of the experiment; 55 SNPs retained statistical significance ($P_{allelic}$<0.05) and 44 have been individually genotyped in sample set 2. Twenty-eight of these were significant ($P_{allelic}$<0.05) and are currently being evaluated in a third independent white Dutch sample set (596 cases and 705 controls).

The most significant non-MHC SNP to emerge from a combined analysis of sample sets 1 and 2 after the PTPN22 missense SNP, rs2476601 [9], was rs1953126, which is an intergenic SNP located 1 kb upstream of the human homologue to the *Drosophila* polycomblike protein-encoding gene, PHF19, on chr 9q33.2 near two candidate genes, TRAF1 and C5 (individual genotyping: Sample Set 1: OR=1.30, 95% CI 1.08-1.58, trend P=0.007; Sample Set 2: OR=1.35, 95% CI 1.18-1.56, trend P=1.69E-05). This SNP was also genotyped in sample set 3 (association: OR=1.16, 95% CI 0.99-1.36, trend P=0.066) (Tables 5-7). No significant deviations from Hardy-Weinberg equilibrium were observed for the genotypes of this SNP in the cases or controls in the three sample sets. The frequency of the minor allele was approximately 30.8% in white North American controls and increasing to 37.3% in white North American cases, and 34.9% in Dutch controls and increasing to 38.3% in Dutch cases. A combined analysis across all three sample sets was highly significant (OR=1.28, 95% CI 1.16-1.40, trend $P_{comb}$=1.45E-06).

Chr 9q33.2 Fine-Mapping and LD Analyses

To further explore the association signal in this region, patterns of LD from the CEU HapMap data [36] were used to define a broad 668 kb region, extending from MEGF9 to STOM on chr9q33.2, for follow-up individual genotyping. Postulating two different disease models, one where the originally identified SNP, rs1953126, was in LD with one or more causative SNPs and a second model of allelic heterogeneity where several alleles at a locus independently predispose individuals to disease, a combination of 137 LD and tagging SNPs were selected from this region for follow-up genotyping in Sample Set 1 (a detailed description of SNP selection is outlined in the "Materials and Methods" section of Example 1 below). Only four SNPs, all in the RAB14-GSN-STOM region, were mildly out of Hardy-Weinberg equilibrium (10−

4<P<0.01) in the controls (Tables 5-7). Including the original SNP, rs1953126, 38 of the 138 chr9q33.2-region SNPs genotyped in Sample Set 1 were significant at the 0.01 level.

To better understand these positive signals and select a subset of informative SNPs for genotyping in the other sample sets, the LD architecture around rs1953126 was investigated by calculating pairwise $r^2$ values for all 138 SNPs genotyped in Sample Set 1. Evaluating cases and controls separately revealed very similar LD patterns between both groups across this region. There were two primary haplotype blocks (LD Block 1 and LD Block 2) (here an LD block is defined as a region in which over 75% of all pairwise $r^2$ LD correlation values exceeded 0.3), with moderate LD between pairs of SNPs residing within each of the two blocks. LD Block 1, which contains the original SNP, rs1953126, and is approximately 70 kb, extends from rs10985070, an intronic SNP in the 5' end of PHF19, across TRAF1 into the TRAF1-C5 intergenic region to rs2900180. Approximately 214 kb in length, LD Block 2 ranges from the middle of C5 to the RAB14-GSN intergenic region. Given that haplotype block structures can have complex LD patterns within and between blocks and that a single associated SNP in this region (rs1953126) was focused on, a higher resolution plot was generated (not shown) where pairwise $r^2$ values were calculated for rs1953126 and each of the remaining 137 SNPs, which revealed groups of highly correlated SNPs not readily visible in the LD heat-map.

Integrating the Sample Set 1 association results with the LD measures, it was found that the original SNP, rs1953126, was highly correlated ($r^2$>0.95) with 17 other SNPs in LD Block 1. These 17 other "Group 1" SNPs in LD Block 1 (in addition to rs1953126) are as follows: rs1609810, rs7034390, rs2270231, rs881375, rs6478486, rs1860824, rs10435844, rs2239657, rs2239658, rs2416805, rs876445, rs7021206, rs1014529, rs1930781, rs2416806, rs7864019, and rs2900180 (additionally, the following SNPs, all of which lie in LD Block 1 between rs10985070 and rs2900180, were not genotyped but highly correlated ($r^2$>0.90) with Group 1 SNPs in the CEU HapMap data: rs1930778, rs10760121, rs1468671, rs7046108, rs10435843, rs758959, rs2109895, rs1930780, rs10739580, rs10733648, and rs7039505). These 18 SNPs (the 17 SNPs above plus rs1953126) have similar association results increasing in frequency from approximately 30-31% in controls to 36-37% in cases (OR=1.29-1.35, trend P~0.002-0.009) (Tables 5-7). It was observed that 20 non-Group 1 SNPs were associated with disease at equal or greater significance including 14 other SNPs from LD Block 1. Thirteen of these other LD Block 1 SNPs, which were highly correlated with one another ($r^2$>0.95) and reasonably correlated with the Group 1 SNPs ($r^2$=0.66-0.72), had minor allele frequencies of approximately 38% in controls, increasing to 46% in cases (OR=1.34-1.39, trend P≤0.002). These 13 "Group 2" SNPs are as follows: rs10985070, rs10985073, rs10818482, rs2072438, rs10760126, rs4836834, rs2416804, rs11018357, rs7021049, rs1930782, rs3761846, rs10760130, and rs10818488 (additionally, the following SNPs, all of which lie in LD Block 1 between rs10985070 and rs2900180, were not genotyped but highly correlated ($r^2$>0.90) with Group 2 SNPs in the CEU HapMap data: rs2269060, rs7037195, rs1014530, rs3761847, and rs10760129). The fourteenth significant SNP in LD Block 1, rs7021880, a TRAF1 intronic SNP, was also highly significant (OR=1.43, trend P=3.12E-04), increasing in frequency from 27.1% in controls to 34.7% in cases. This SNP was in LD with both the Group 1 ($r^2$=0.82-0.90) and the Group 2 SNPs ($r^2$=0.59-0.64) SNPs. The six other SNPs with P values <0.01 lie upstream of LD Block 1 (n=4) or downstream of LD Block 2 in GSN (n=2) (Tables 5-7). The PSMD5 intronic SNP, rs10760117, was particularly significant among these six SNPs.

Given the association results and the LD structure, 72 of the 137 fine-scale mapping SNPs were selected to genotype in Sample Set 2 (661 white North American RA patients and 1322 matched white North American controls) (Tables 5-7). This subset of fine-scale mapping SNPs was chosen to reduce the genotyping load, while capturing the association signals and retaining full coverage of the genetic variation in this region. Two of these 72 SNPs, rs12683062 (in CEP110) in the cases and rs9409230 (a RAB14-GSN intergenic SNP) in the controls, were moderately out of Hardy-Weinberg equilibrium (P=2.56E-04 and P=0.003, respectively; Tables 5-7). Including the original SNP, rs1953126, 23 of these 72 SNPs were significant (trend P<0.01) in Sample Set 2; however, the nine significant LD Block 1 SNPs in Sample Set 1 were the most significant, replicated SNPs in Sample Set 2. There were three SNPs in GSN (rs10985196, rs7046030 and rs12683459), all highly correlated with pairwise $r^2$ values >0.90, which were highly significant (trend P<10$^{-6}$) in Sample Set 2 (Sample Set 1: trend P=0.01-0.05).

Forty-two SNPs were genotyped in Sample Set 3 (596 white Dutch RA patients and 705 white Dutch controls); none of these SNPs rejected HWE at the P<0.01 significance level (Tables 5-7). These 42 SNPs span over 600 kb and were selected to cover genetic variability, association patterns and gene boundaries. Four of the 42 SNPs, spanning 286 kb from TRAF1 to RAB14, were significant at the 0.01 level. Of these four, two SNPs (rs4836834 and rs7021049) were members of Group 2 from LD Block 1, perfectly correlated ($r^2$=1), and both SNPs were highly significant in all three sample sets. The six Group 1 SNPs genotyped in Sample Set 3 were close to the 0.05 significance level, with the most significant of these being the synonymous P340P TRAF1 SNP, rs2239657 and the TRAF1-C5 intergenic SNP, rs2900180 (trend P=0.052) (Tables 5-7) (for the TRAF1 intronic SNP, rs7021880, trend P=0.102 in this sample set).

In a combined analysis of the 43 SNPs genotyped in all three sample sets, including the original SNP, rs1953126, 20 SNPs, spanning a region of over 525 kb from rs7026635 within FBXW2 to rs 10818527 within GSN, were significantly associated with RA (trend $P_{comb}$<0.01) (Table 9). Several of these SNPs exhibited consistent and strong association across all three sample sets (Tables 5-7). Using either a combined trend or genotypic P-value, the top-ranked five SNPs were: rs6478486, rs4836834, rs2239657, rs7021880 and rs7021049 (listed in order of position). All reside within or near TRAF1 in LD Block 1, had common odds ratios of approximately 1.3, and were highly significant (trend $P_{comb}$<1.5E-07) (Table 9).

Multiple Testing

Since false-positive results can be problematic in any large-scale experiment in which modest nominal significance levels are used, the results from the combined analysis were corrected for multiple testing using the method of Dunn-Sidak [37]. Seven SNPS, all within LD Block 1, survived a Dunn-Sidak correction for 25,966 SNPs at P<0.01. The corrected trend $P_{comb}$ values for the five most significant SNPs were: 0.003 for rs6478486 and 0.004 for rs223957 (Group 1), 0.002 for rs4836834 and 0.001 for rs7021049 (Group 2), and 1.4E-04 for rs7021880.

Haplotype Sliding Window

Given that the fine-scale-mapping SNPs cluster into various groups based on their pairwise $r^2$ values and that under many models haplotypes can be more informative than single-markers [38], the Haplo-Stats package [39] was used to run a 5-SNP sliding-window haplotype association analysis on the 43 SNPs genotyped in all three sample sets separately for each sample set and then the statistical evidence was combined across all three sample sets. The combined analysis revealed a 29 kb-wide maximum peak of global association for haplotypes comprised of alleles segregating at rs6478486-rs4836834-rs2239657-rs7021880-rs7021049 in LD Block 1 ($P_{comb}$=4.15E-08). This region ranges from 9 kb downstream of TRAF1 in the PHF19-TRAF1 intergenic region to intron 3 within TRAF1. The disease association evidence for this PHF19-TRAF1 region was particularly strong. Aside from this peak and a second highly significant peak in the TRAF1 region ($P_{comb}$=5.45E-08; rs2239657-rs7021880-rs7021049-rs2900180-rs2269066), a second region of significance was centered over the RAB14-GSN region (P=2.11E-06).

Haplotype Analyses of LD Block 1 Variants

The single marker and sliding window haplotype analyses pointed to LD Block 1 as harboring RA-associated SNPs. The TRAF1 intronic SNP, rs7021880, was the most significant SNP in Sample Sets 1 (trend P=3.12E-04) and 2 (trend P=5.09E-07) and in the combined analysis (trend $P_{comb}$=5.41E-09) (in the Dutch sample set, trend P=0.102). In the Dutch sample set, the Group 2 SNPs, rs4836834 and rs7021049, were the most significant (trend P=0.004 and 0.006, respectively) (Tables 5-7 and 9). These Group 2 SNPs ranked second in significance in Sample Set 1 and in the combined analysis while in Sample Set 2 they ranked third behind rs7021880 and the Group 1 SNPs.

Given these results, the haplotype structure of LD Block 1 was analyzed using a subset of the nine SNPs from this region genotyped in all three studies. Taking into account the LD structure, the following three SNPs were selected for these analyses: rs2239657, the P340P TRAF1 synonymous polymorphism (to represent the six Group 1 SNPs); rs7021049, a TRAF1 intronic SNP (to represent the two Group 2 SNPs); and rs7021880. Haplotype frequencies for these three SNPs were estimated using the Haplo.Stats package [39], revealing the same four common haplotypes in each study (Table 10). Two of these haplotypes, AGT and GCG, were strongly associated with disease ($P_{comb}$=3.08E-08 and 8.00E-09, respectively), with the former being protective—decreasing in frequency from ~60.9% in North American controls to 53.8% in North American cases and 56.7% in Dutch controls to 51.2% in Dutch cases ($OR_{common}$=0.76, 95% CI 0.70-0.83); and the latter being susceptible—increasing from 27.0% in North American controls to 34.7% in North American cases and from 33.2% in Dutch controls to 36.0% in Dutch cases ($OR_{common}$=1.32, 95% CI 1.21-1.45). These haplotype $P_{comb}$-values were not significantly different from those calculated for the individual SNPs (Table 9).

Dosage Effects

To explore the effect of the number of copies of each haplotype at these three sites (rs2239657, rs7021880 and rs7021049) along with any dominant/recessive effects between haplotypes, diplotypes were estimated using the pseudo-Gibbs sampling algorithm from the program SNPAnalyzer [40]. Analyzing the diplotypes individually, two diplotype combinations achieved statistical significance (P<0.01) when compared to all other diplotypes (Table 11). The AGT/AGT diplotype was strongly associated with protection against RA ($P_{Comb}$=5.35E-07; $OR_{Common}$=0.68, 95% CI 0.59-0.78), whereas the less frequent GCG/GCG diplotype was associated with predisposition ($P_{Comb}$=0.005; $OR_{Common}$=1.42, 95% CI 1.16-1.75).

Assuming a disease prevalence of 1%, the relative risk of RA was calculated in those individuals carrying two copies of the protective AGT haplotype compared to those without the AGT haplotype ($RR_{2\ copies\ AGT}$=0.77). This homozygous relative risk was substantially reduced from the relative risk calculated from individuals carrying only one copy of the AGT haplotype ($RR_{1\ copy\ AGT}$=1.06.). Similarly, the relative risks for the susceptible GCG haplotype were estimated ($RR_{2\ copies\ GCG}$=1.38; $RR_{1\ copy\ GCG}$=1.15).

Genetic Background-Conditioned Results

A collection of 749 SNPs informative for European substructure was used to stratify both the cases and controls in Sample Set 2 [41]. By partitioning cases and controls into similar genetic background groups ("Northern European" or "Other"), the aim was to interrogate the data for strata-specific effects—that is, whether or not association signals were specific to one of these genetic background groups—and avoid potential confounding by population stratification. Although two SNPs demonstrated moderately higher significance levels following stratification—rs16910233 in C5 ($P_{North}$=00.019 compared to $P_{Unstrat}$=0.147) and rs12685539 in CEP110 ($P_{Other}$=0.038 compared to $P_{Unsrtat}$=0.115), a Breslow-Day test of effect heterogeneity comparing $OR_{North}$ and $OR_{Other}$ was not significant. Furthermore, a positional plot of Mantel-Haenszel P-values, testing for association given the genetic background stratification, was very similar to the unadjusted plot (not shown) suggesting that stratification of the case and control samples by SNPs informative for European substructure did not change the association patterns in Sample Set 2.

Rheumatoid Factor (RF)

Rheumatoid factor, a circulating antibody to immunoglobulin G, is a key serum analyte used in diagnosis of RA as well as an aid for the prognosis of RA-severity [2]. As the R620 W missense polymorphism in PTPN22 appears to have stronger susceptibility effects for RF-positive disease [9] and since RF is clinically important, the role of RF status on the chr 9q33.2 association patterns was investigated for the three LD Block 1 SNPs, rs2239657, rs7021880 and rs7021049, testing for both strata-specific effects as well as effect size differences between RF-positive and RF-negative disease.

To explore the effect isolated to RF-positive patients compared to controls, a strata-specific analysis was performed for all sample sets using a genotypic test. The resulting combined P-values for the RF-positive stratum were highly significant ($P_{rs2239657}$=4.02E-05, $P_{rs7021880}$=7.10E-06, $P_{rs7021049}$=5.68E-06; Table 12), which were slightly less significant when compared to the overall genotypic combined P-values (Table 9). A similar analysis of RF-negative disease in Sample Sets 2 and 3 yielded genotypic combined P-values of $P_{rs2239657}$=0.038, $P_{rs7021880}$=0.013 and $P_{rs7021049}$=0.082. Allelic odds ratios and 95% confidence intervals were also calculated for each individual sample set and the results did not demonstrate a clear pattern of strata-specific effects within a stratum or differential effects between the two strata (Table 12). A Breslow-Day test was performed on Sample Set 2 (individually matched cases and controls) to formalize the test of homogeneity of odds ratios, showing that none of the three SNPs exhibited significant differential effects (Table 12). Similarly, results for the analogous Monte Carlo-based test performed in Sample Set 3 (where cases and controls were not individually matched) also did not reveal significant heterogeneity between RF-positive and RF-negative effects.

Logistic Regression

Logistic regression was used to further dissect association signals from LD patterns, build predictive models, and explore the relative effects of each SNP within the models constructed. To accomplish this, the number of SNPs for these analyses was first minimized by calculating pairwise $r^2$ values for the 43 SNPs genotyped in all three sample sets, and the SNPs were divided into distinct groups based on their LD structure. SNPs with pairwise $r^2$ values >0.90 were grouped together, resulting in 27 distinct groups (Table 13) and then the single most significant SNP from each group ($P_{comb}$ from Table 9) was chosen for the logistic regression analyses.

In the univariate analysis, the TRAF1 intronic SNP rs7021049, which marks the Group 2 SNPs in LD Block 1, was the most significant SNP (P=1.24E-06), followed by rs7021880 (1.39E-06), and then the Group 1 SNP, rs2239657 (P=2.52E-06) (Table 13). In addition, 11 other SNPs were significant (P<0.01). To assess whether other observed associations in the region were primarily a result of LD with the most significant SNP, pairwise logistic regression was performed on all 27 SNPs, adjusting for rs7021049. One SNP retained statistical significance (P<0.01): rs10985196 (Group 21), a GSN intronic SNP (P=0.001). To test whether the combination of Group 2 and Group 21 variants fully accounted for the association with RA, the logistic regression was repeated, adjusting for both rs7021049 and rs10985196; none of the remaining groups of SNPs were significantly associated with RA.

To explore more complex models, both forwards and backwards stepwise logistic regression procedures were used separately on the same 27 SNPs in each individual sample set as well as in a combined analysis of all three sample sets (Table 14). The forward model for the combined samples, which included two SNPs, rs7021049 (the Group 2 TRAF1 intronic SNP) and rs10985196 (the GSN intronic SNP), was consistent with the results of the pairwise logistic regression analysis presented above.

Multi-Locus RA Risk Calculations

The risk of RA given genotypes at the three loci HLA-DRB1, PTPN22 and the TRAF1 region was estimated under three different possible unconditional RA risk assumptions (i.e., RA disease prevalence values) using Bayes' theorem. In total, there were 18 multi-locus genotype combinations, and RA risk was calculated for each combination using data from Sample Set 1 as described in the "Materials and Methods" section of Example 1 below. Assuming a 1% RA prevalence, similar to that observed in the white North American general population, the results indicate that individuals with the protective genotype at all three loci (0SE for HLA-DRB1, CC genotype for PTPN22 and the AGT/AGT TRAF1 diplotype) have a substantially reduced predicted risk of RA (0.29% vs. 1%), whereas those individuals in the highest-risk category (HLA-2SE, TT or TC genotype at PTPN22, and the GCG/GCG TRAF1 diplotype), have an estimated RA risk of 13.06%, representing more than a 45-fold increase in risk. These data are presented as a 3-D plot in FIG. 1 where the lowest risk value has been reset to 1 and the other values normalized accordingly. Approximately 19% of the general population will find themselves in the low-risk multi-locus genotype category and only 0.06% in the high risk group. In contrast, when the disease prevalence is increased to 30%, as might be observed in high-risk groups such as an early arthritis clinic, the range of risk drops to 7.88-fold, with the posterior probability of RA calculated to be 11% for the lowest-risk genotype combination and increasing to 86.4% in the highest risk category (Table 15).

DISCUSSION

A large-scale, multi-tiered association study of RA was carried out using a panel of putative functional SNPs, particularly focuses on variants in the chromosome 9q33.2 region. In particular, three groups of SNPs, represented by rs2239657 (Group 1), rs7021049 (Group 2) and rs7021880 were highly significant and showed a localized effect to a 70 kb region extending from rs10985070, in intron 3 of PHF19, across TRAF1 to rs2900180 in the TRAF1-C5 intergenic region, but excluding the C5 coding region (LD Block 1). Examination of the CEU HapMap data identified 16 additional SNPs (rs1930778, rs10760121, rs1468671, rs7046108, rs10435843, rs758959, rs2109895, rs1930780, rs10739580, rs10733648, rs7039505, rs2269060, rs7037195, rs1014530, rs3761847, rs10760129) that were highly correlated ($r^2$>0.95) with either the Group 1 or Group 2 SNPs genotyped in this study, and all 16 fall within this 70 kb region. Across sample sets, the evidence for association at these sites was stronger, maintaining statistical significance after correction for multiple testing, and more consistent than sites in neighboring regions. Additional analyses further buttressed the statistical support for these conclusions: (i) a haplotype sliding window analysis of all SNPs genotyped in the chr 9q33.2 region demonstrated strong statistical evidence for the TRAF1-region harboring RA risk variants ($P_{comb}$=4.15E-08) and (ii) haplotype analysis of SNPs within the 70 kb LD Block 1, identified a common protective haplotype ($P_{comb}$=3.08E-08) and a less frequent risk haplotype ($P_{comb}$=8.00E-09). The three representative SNPs (rs2239657, rs7021049 and rs7021880) were strongly associated with RF-positive disease and trended towards association in RF-negative disease.

Logistic regression was used to tease apart association signals from LD patterns. The pairwise analyses of the combined datasets suggest there may be two independent statistical signals of association to RA at chr 9q33.2—one in the TRAF1 region represented by rs7021049 and one in the GSN region represented by rs10985196 (Table 13). Analyses of the individual sample sets showed rs10985196 was independently associated with disease risk in Sample Set 2 while rs7021049 shows consistent association across all three sample sets (data not presented).

The original RA-associated, 9q33.2 SNP identified in the genome-wide scan, rs1953126, is located within LD Block 1, 1 kb upstream of the 5' end of PHF19, the human homologue of the *Drosophila* polycomblike protein (PCL) gene. In *Drosophila*, the protein encoded by this gene is part of the 1 MDa extra sex combs and enhancer of zeste [ESC-E(Z)] complex which is thought to mediate transcriptional repression by modulating the chromatin environment of many developmental regulatory genes such as homeobox genes. In humans, this gene encodes two nuclear proteins that appear to be upregulated in multiple cancers, and preliminary evidence suggests that deregulation of these genes may play a role in tumor progression [49].

TRAF1 encodes a protein that is a member of the TNF receptor (TNFR) associated factor (TRAF) protein family that associates with, and mediates, signal transduction from various receptors including a subset of the TNFR superfamily. There are six members of this family of adaptor proteins; however, TRAF1 is unique in that while it contains the hallmark carboxyl-terminal TRAF domain, it has a single zinc finger in the amino-terminal part, and the N-terminal RING finger domain (required for NF-κB activation) is missing. TRAF1 appears to have both anti-apoptotic and anti-proliferative effects [50,51]. In addition, this protein has been found to be elevated in malignancies of the B cell lineage [52-57]. This observation is interesting given that the risk of lymphoma, particularly diffuse large B cell lymphomas, appears to be increased in the subset of RA patients with very severe disease, independent of treatment [58,59]. It is clear that TRAF1 plays an important role in immune cell homeostasis, making it an excellent candidate gene for RA. Further, in vitro work suggests that TNFα-mediated synovial hyperplasia, a major pathophysiologic feature of RA, may be correlated with upregulation of TRAF molecules, particularly TRAF1 [60]. Given that TNF blockade has proved a highly effective therapy for RA [61,62], and response to TNF inhibitors among RA patients is known to vary, TRAF1 variants can be useful for assessing (e.g., predicting) an individual's response to TNF inhibitors as well as other drug treatments.

SNPs in LD Block 1 could differentially regulate the expression of the C5 gene. C5 encodes a zymogen that is involved in all three pathways of complement activation. Traditionally, the complement system has been viewed as a central part of the innate immune system in host defenses against invading pathogens and in clearance of potentially damaging cell debris; however complement activation has also recently been implicated in the pathogenesis of many inflammatory and immunological diseases. Proteolytic cleavage of C5 results in C5a (one the most potent inflammatory peptides) and C5b (a component of the membrane attack complex (MAC) that can cause lysis of cells and bacteria). Genetic studies in various mouse models of RA, including collagen-induced arthritis (CIA) and the K/BXN T cell receptor transgenic mouse model of inflammatory arthritis, have provided evidence that C5 (or a variant in strong LD) plays a role in disease [63-65]. Furthermore, anti-C5 monoclonal antibody therapy can prevent and ameliorate disease in both mouse models [66,67].

Thus, a region on chromosome 9q33.2, particularly variants in TRAF1, is identified herein as being associated with risk for RA. In addition to developing targeted therapies with knowledge of predisposing variants underlying the onset of RA, the identification of RA susceptibility alleles may encourage earlier monitoring and provide an intervention avenue in advance of significant joint erosion. The analysis disclosed herein of the three known genetic risk factors (the chr 9q33.2 variants disclosed herein, as well as HLA-SE and PTPN22) indicates a >45-fold difference in RA risk depending on an individual's genotype at these three loci. These genetic variants are useful for identifying individuals at increased risk for developing RA, particularly within families with a history of RA, and are also useful as drug response markers, particularly for assessing differential response to TNF inhibitors and other drugs.

Materials and Methods

Subjects and Samples

All RA cases included in this study were white and met the 1987 American College of Rheumatology diagnostic criteria for RA [68]; informed written consent was obtained from every subject. Sample Set 1, which consisted of 475 RA cases and 475 individually-matched controls, was collected by Genomics Collaborative, Inc. All case samples were white North Americans of European descent who where rheumatoid factor (RF) positive. Control samples were healthy white individuals with no medical history of RA, also of European descent. A single control was matched to each case on the basis of sex, age (±5 years), and self-reported ethnic background. The 661 cases in Sample Set 2 were acquired from the North American Rheumatoid Arthritis Consortium (NARAC) and consisted of members from 661 white North American multiplex families [33,69,70]. Both RF-positive and RF-negative patients were included in this sample set. Controls for Sample Set 2 were selected from 20,000 healthy individuals enrolled in the New York Cancer Project [71], a population-based prospective study of the genetic and environmental factors that cause disease. Two control individuals were matched to a single, randomly chosen affected sibling from each NARAC family on the basis of sex, age (decade of birth), and self-reported ethnic background. Sample Set 3 was composed of 596 white RA patients from the Leiden University Medical Center and 705 white controls from the same geographic region in The Netherlands [72-74]. Both RF-positive and RF-negative patients were included in this sample set. Table 8 displays the clinical characteristics of all three sample sets and a detailed description of samples that overlap with published studies of this region [34,35].

Controls (which may also be referred to as "healthy" or "normal" individuals), in addition to having no medical history of RA, also were free of psoriasis, systemic lupus erythematosus, ankylosing spondylitis, and Reiter syndrome, had rheumatoid factor levels below 20 IU, and had no history of bone marrow transplants.

Functional Genome-Wide Scan

The functional genome-wide scan included 25,966 gene-centric SNPs curated from dbSNP, the Applera Genome Initiative [44,75], and the literature. SNPs were included if they appeared in more than one database and had a minor-allele frequency >1%. Approximately 70% of the SNPs were annotated as missense polymorphisms. The majority of the remaining SNPs were either located within putative transcription-factor site motifs or within acceptor/donor splice site regions or were nonsense polymorphisms.

Genotyping

Allele-specific, real-time quantitative PCR [76] was used to amplify 3 ng of pooled DNAs and infer SNP allele frequencies as previously detailed [44]. Individual genotyping on SNPs was performed on 0.3 ng of DNA using a similar protocol. Blinded to case-control status, custom-made in-house software was used to call genotypes, followed by hand-curation. Individual genotyping accuracy has been estimated to be >99.8% by comparison with an independent method. HLA-DRB1 genotyping was performed using sequence-specific oligonucleotide probes as previously described [9]. Shared epitope (SE) status [77] was determined from the probe hybridization patterns. For this study, DRB1 alleles positive for the SE include: 0101, 0102, 0401, 0404, 0405, 0408 and 1001.

Fine-Scale Mapping SNP Selection

To identify SNPs for inclusion in fine-scale mapping of the 9q33.2 region, two different disease models were postulated: 1) a model where the originally identified SNP is in linkage disequilibrium with one or more causative SNPs and 2) a model of allelic heterogeneity where several alleles at the locus independently predispose individuals to RA. To address both of these models, the region to be interrogated was first defined by calculating pairwise linkage disequilibrium ($r^2$) values between the originally identified SNP 5' of PHF19, rs1953126, and all HapMap-genotyped SNPs within 500 kb flanking either side for the CEPH samples (Utah residents with ancestry from northern and western Europe, or CEU individuals) [36]. With this information, a broad region was defined spanning 668 kb, from MEGF9 (177 kb upstream of rs1953126) to STOM (491 kb downstream of rs1953126), for follow-up genotyping. SNPs within this region were partitioned into those in moderate to high LD ($r^2>0.20$) with rs1953126 to address the first model, and those in low LD ($r^{2<0.20}$) with rs1953126 to address the second model. The power-based SNP selection program Redigo [78] was then used on the low LD set of SNPs to identify a reduced number of SNPs (tagging SNP set) that retained high power to detect association. Those SNPs in moderate to high LD with the original SNP were reduced by selecting a subset of representative SNPs of any groups exhibiting extremely high inter-group LD ($r^2>0.98$). Further, any putative functional SNPs were automatically included in the fine-scale mapping effort if high-quality genotyping assays could be constructed for them. The resulting set of 137 SNPs was genotyped in Sample Set 1 and the data analyzed. Additional removal of fine-scale mapping SNPs was performed for evaluation in subsequent sample sets on the basis of association results and refined LD patterns: a subset of 72 SNPs were selected for genotyping in Sample Set 2 and 42 SNPs were genotyped in Sample Set 3.

Statistical Analyses

The Cochran-Armitage trend test [79] was used to calculate P-values for individual SNPs. A William's-corrected G-test [37] was used to calculate P-values for genotypic association. P-values were corrected for multiple testing using the method of Dunn-Sidak [37]. Odds ratios and confidence intervals were calculated according to standard procedures. Hardy-Weinberg equilibrium testing was accomplished through the exact test of Weir [80]. P-values were combined across sample sets using the Fisher's combined P-value, or omnibus procedure [81]. Likewise, Mantel-Haenszel common odds ratios [82] were calculated to combine data across sample sets. To avoid the small-count limitations of asymptotic-derived confidence intervals, a Monte Carlo simulation was written in XLISP-STAT to calculate 95% confidence intervals on the Mantel-Haenszel common odds ratios. 20,000 iterations of the Monte Carlo were typically performed for these confidence intervals. The standard measure of pairwise linkage disequilibrium (the $r^2$ statistic from estimated 2-site haplotypes) was used to characterize the genetic architecture of the region. The program LDMAX with an EM algorithm was used to perform the $r^2$ calculation [83].

Genetic Analyses

Haplotype Analysis

Haplotypes were estimated from unphased genotype data and evaluated for association with RA through the Haplo.Stats software package [39]. A sliding window of haplotype association was calculated using a window size of 5 SNPs. Global P-values (calculated across all haplotypes within a window) and haplotype-specific ORs and P-values were calculated. Additional haplotype analyses were performed using a combination of the Pseudo-Gibbs sampling algorithm in the program SNPAnalyzer [40] and the Haplo.Stats package.

Genetic Background-Conditioned Analysis

A panel of 749 SNPs previously selected to be informative for classifying individuals of European descent into Northern and Southern geographical groups was applied to case and control samples from the second sample set as described previously [41]. Applying this method, 367 cases and 525 controls from Sample Set 2 were placed into a northern European ancestry cluster. Each case or control individual had a greater than 0.95 probability of belonging to the northern European cluster. The remaining cases and controls from this study were binned into an "Other" category. A Breslow-Day analysis [84] was applied to the stratified data to test for heterogeneity in ORs between the two groups for the 9q33.2-linked SNPs studied here. To test for association conditioned on these stratified data, a Mantel-Haenszel P-value was also calculated.

Subphenotype Analysis: Rheumatoid Factor

Rheumatoid Factor (RF) levels were measured in cases as previously described [85,86]. To test for heterogeneity of effect between RF-positive and RF-negative patients, two different methods were used. In sample set 2, where case-control matching was part of the study design, the Breslow-Day [84] test was used. Since individual matching was not incorporated into Sample Set 3, a Monte Carlo simulation was used to compare the effect size for RF-positive patients versus all controls to the effect size for RF-negative patients versus all controls. Similar to other tests of homogeneity of odds ratios, a test statistic was constructed measuring the departure between normalized odds ratios comparing two groups (see equation S1 in the "Supporting Information" section of Example 1 below) and a Monte Carlo simulation was run to account for correlated odds ratios in the null distribution. Monte Carlo P-values were calculated in the traditional manner.

Logistic Regression

Logistic regression models were performed to assess the relative importance of 27 SNPs chosen as distinct representatives of groups of SNPs with pairwise $r^2$ values >0.90. First, a logistic regression model for each unique pair of SNPs was performed. These pairwise models assumed a multiplicative effect on the risk of RA for each additional copy of an allele. The p-values and odds ratios for the effect of each SNP when controlling for each alternative SNP were examined visually to determine if any SNP showed obvious patterns (attenuating the risk of each alternate SNP and retaining risk when adjusted for each alternate SNP). These types of patterns might be expected under a disease model of a single functional SNP. For models in which both SNPs remained strongly associated (p<0.01), additional models were performed to determine if adding a third SNP significantly improved the model. To examine multi-SNP relationships in a more automated fashion, both a forward as well as a backward stepwise logistic regression procedure was performed on each sample set individually as well as on the combined sample sets. The stepwise models were performed coding the genotypes with indicator variables and with a significance level of 0.05 for the 2 degree of freedom score test (for entry) or Wald test (for exit) on the effect of the SNP used as a threshold for entry or exit from the model. Models applied to the combined sample sets also forced sample set as a covariate in the model. The final model from each procedure was also applied to the other sample sets to assess consistency of the models across sample sets. The p-value from the likelihood ratio test of the global null hypothesis for each model is reported. All logistic regression models were performed using SAS version 9.

Multi-Locus RA Risk Calculations

Risk for RA given every possible 3-locus genotype combination at the HLA-DRB1 shared epitope, the R620 W SNP in PTPN22, and 3-SNP TRAF1 diplotypes was calculated for sample set 1 using Bayes' theorem (see equations S2 and S3 in the "Supporting Information" section of Example 1 below) assuming conditional independence between loci (the commonly-used Naive Bayes model for predictive modeling) and a range of RA prevalence values (1%, 10% and 30%). Theoretical calculations (not shown) demonstrate that unless both sample sizes and epistatic effects are very large, probability estimates of the jointly-occurring genotypes have lower error rates assuming conditional independence between loci. Therefore, fully-factorizing the probability of multi-locus genotypes (using the conditional independence assumption) is warranted under a broad range of the parameter space. By estimating the posterior probability of RA for every possible multi-locus genotype combination, accurate individual-based prognosis is possible. Confidence intervals on the relative risk estimates were obtained through simulation. Due to the selection of loci for inclusion in the model, some overfitting may be present.

Supporting Information

Rheumatoid Factor Analysis

Investigating the effect heterogeneity between two case groups, RF-positive and RF-negative disease, with the same group of controls, a Monte Carlo procedure was devised using a simple test statistic to measure the normalized departure between two odds ratios. As the correlated nature of the two odds ratios were automatically incorporated into the Monte Carlo simulation, the appropriate null distribution of this test statistic was obtained without complicated analytic techniques. The test statistic constructed was $$T = \left( \frac{\ln OR_1}{\sqrt{\frac{1}{x_1} + \frac{1}{x_2} + \frac{1}{z_1} + \frac{1}{z_2}}} - \frac{\ln OR_2}{\sqrt{\frac{1}{y_1} + \frac{1}{y_2} + \frac{1}{z_1} + \frac{1}{z_2}}} \right)^2; \quad \text{(eqn S1)}$$

where $OR_1$ is the allelic odds ratio comparing RF-positive cases to the control group; $OR_2$ is the allelic odds ratio comparing RF-negative cases to the control group; and $x_1$ and $x_2$ are the allelic counts for the $A_1$ allele and $A_2$ allele in the RF-positive case group, respectively. Using similar notation, $y_1$ and $y_2$ are the allelic counts in RF-negative cases, and $z_1$ and $z_2$ are the allelic counts in the control group.

Multilocus RA Risk Calculations

The probability of RA given the genotypes at the three predisposing loci is $$P(RA \mid G_{HLA}, G_{PTPN22}, G_{TRAF1}) = \frac{P(G_{HLA}, G_{PTPN22}, G_{TRAF1} \mid RA) P(RA)}{P(G_{HLA}, G_{PTPN22}, G_{TRAF1})} \quad \text{(eqn S2)}$$

Assuming conditional independence, one can fully factorize $$\approx \frac{P(RA) \prod P(G \mid RA)}{P(RA) \prod P(G \mid RA) + [1 - P(RA)] \prod P(G \mid CT)} \quad \text{(eqn S3)}$$

where P(RA) is the probability of RA, and where P(G|RA) and P(G|CT) are the probabilities of a genotype in RA patients and controls, respectively.

REFERENCES

Corresponding to Example 1

1. Silman A J and Pearson J E. (2002) Epidemiology and genetics of rheumatoid arthritis. Arthritis Res. 4 (suppl 3): S265-S272.
2. Firestein, G S. (2003) Evolving concepts of rheumatoid arthritis. Nature 423:356-361.
3. Scott D L, Kingsley G H. (2006) Tumor necrosis factor inhibitors for rheumatoid arthritis. N Engl J Med 355:704-712.
4. Callahan L F, Pincus T. (1995) Mortality in the rheumatic diseases. Arthritis Care Res. 8:229-241.
5. MacGregor A J, Snieder H, Rigby A S, Koskenvuo M, Kaprio J, et al. (2000) Characterizing the quantitative genetic contribution to rheumatoid arthritis using data from twins. Arthritis Rheum. 43: 30-37.
6. Stastny P (1978) Association of the B-cell alloantigen DRw4 with rheumatoid arthritis. N Engl J Med 298:869-871.
7. Hasstedt S J, Clegg D O, Ingles L, Ward R H (1994) HLA-linked rheumatoid arthritis. Am J Hum Genet. 55:738-746.
8. Wordsworth P, Bell J. (1991) Polygenic susceptibility in rheumatoid arthritis. Ann Rheum Dis 50:343-346.
9. Begovich A B, Carlton V E, Honigberg L A, Schrodi S J, Chokkalingam A P, et al. (2004) A missense single-nucleotide polymorphism in a gene encoding a protein tyrosine phosphatase (PTPN22) is associated with rheumatoid arthritis. Am J Hum Genet. 75:330-337.
10. Plenge R M, Padyukov L, Remmers E F, Purcell S, Lee A T, et al. (2005) Replication of putative candidate-gene associations with rheumatoid arthritis in >4,000 samples from North America and Sweden: association of susceptibility with PTPN22, CTLA4, and PADI4. Am J Hum Genet. 77:1044-1060.
11. Gregersen P K, Lee H S, Batliwalla F, Begovich AB (2006) PTPN22: setting thresholds for autoimmunity. Semin Immunol. 18:214-223.
12. Suzuki A, Yamada R, Chang X, Tokuhiro S, Sawada T, et al. (2003) Functional haplotypes of PADI4, encoding citrullinating enzyme peptidylarginine deiminase 4, are associated with rheumatoid arthritis. Nat. Genet. 34:395-402.
13. Lee Y H, Rho Y H, Choi S J, Ji J D, Song G G (2007) PADI4 polymorphisms and rheumatoid arthritis susceptibility: a meta-analysis. Rheumatol Int 27:827-833
14. Remmers E F, Plenge R M, Lee A T, Graham R R, Hom G, et al. (2007) STAT4 and the risk of rheumatoid arthritis and systemic lupus erythematosus. N Engl J Med 357:977-986.
15. Plenge R M, Cotsapas C, Davies L, Price A L, de Bakker P I, et al (2007) Two independent alleles at 6q23 associated with risk of rheumatoid arthritis. Nat Genet. 39: 1477-1482.
16. Thomson W, Barton A, Ke X, Eyre S, Hinks A, et al (2007) Rheumatoid arthritis association at 6q23. Nat Genet. 39: 1431-1433.
17. Kochi Y, Yamada R, Suzuki A, Harley J B, Shirasawa S, et al. (2005) A functional variant in FCRL3, encoding Fc receptor-like 3, is associated with rheumatoid arthritis and several autoimmunities. Nat Genet. 37:478-485.
18. Ikari K, Momohara S, Nakamura T, Hara M, Yamanaka H, et al. (2006) Supportive evidence for a genetic association of the FCRL3 promoter polymorphism with rheumatoid arthritis. Ann Rheum Dis 65:671-673.
19. Tokuhiro S, Yamada R, Chang X, Suzuki A, Kochi Y, et al. (2003) An intronic SNP in a RUNX1 binding site of SLC22A4, encoding an organic cation transporter, is associated with rheumatoid arthritis. Nat. Genet. 35:341-348.
20. Choi C B, Kang C P, Seong S S, Bae S C, Kang C. (2006) The −169 C/T polymorphism in FCRL3 is not associated with susceptibility to rheumatoid arthritis or systemic lupus erythematosus in a case-control study of Koreans. Arthritis Rheum 54:3838-3841.
21. Orozco G, Sanchez E, Gonzalez-Gay M A, Lopez-Nevot M A, Torres B, et al. (2006) SLC22A4, RUNX1, and SUMO4 polymorphisms are not associated with rheumatoid arthritis: a case-control study in a Spanish population. J Rheumatol 33:1235-1239.
22. Begovich A B, Chang M, Schrodi S J (2007) Meta-analysis evidence of a differential risk of the FCRL3-169T→C polymorphism in white and East Asian rheumatoid arthritis patients. Arthritis Rheum 56:3168-3171.
23. Becker K G, Simon R M, Bailey-Wilson J E, Freidlin B, Biddison W E, et al. (1998) Clustering of non-major histocompatibility complex susceptibility candidate loci in human autoimmune diseases. Proc Natl Acad Sci USA 95:9979-9984.
24. Bottini N, Musumeci L, Alonso A, Rahmouni S, Nika K, et al. (2004) A functional variant of lymphoid tyrosine phosphatase is associated with type I diabetes. Nat Genet. 36:337-338.

25. Welcome Trust Case Control Consortium (2007) Genome-wide association study of 14,000 cases of seven common diseases and 3,000 shared controls. Nature 447: 661-678.
26. Jorde L B (1995) Linkage disequilibrium as a gene-mapping tool. Am J Hum Genet. 56:11-14.
27. Risch N and Merikangas K. (1996) The future of genetic studies of complex human diseases. Science 273:1516-1517.
28. Long A D, Grote M N, Langley C H (1997) Genetic analysis of complex diseases. Science 275:1328.
29. Duerr R H, Taylor K D, Brant S R, Rioux J D, Silverberg M S, et al (2006) A genome-wide association study identifies IL23R as an inflammatory bowel disease gene. Science 314:1461-1463.
30. McPherson R, Pertsemlidis A, Kavaslar N, Stewart A, Roberts R, et al (2007) A common allele on chromosome 9 associated with coronary heart disease. Science 316:1488-1491.
31. Helgadottir A, Thorleifsson G, Manolescu A, Gretarsdottir S, Blondal T, et al (2007) A common variant on chromosome 9p21 affects the risk of myocardial infarction. Science. 316:1491-1493.
32. Cargill M, Schrodi S J, Chang M, Garcia V E, Brandon R, et al. (2007) A large-scale genetic association study confirms IL12B and leads to the identification of IL23R as psoriasis-risk genes. Am J Hum Genet. 80:273-290.
33. Carlton V E, Hu X, Chokkalingam A P, Schrodi S J, Brandon R, et al. (2005) PTPN22 genetic variation: evidence for multiple variants associated with rheumatoid arthritis. Am J Hum Genet. 77:567-581.
34. Plenge R M, Seielstad M, Padyukov L, Lee A T, Remmers E F, et al. (2007) TRAF1-C5 as a risk locus for rheumatoid arthritis—a genomewide study. N Eng J Med 357:1199-1209.
35. Kurreeman FAS, Padyukov L, Marques R B, Schrodi S J, Seddighzadeh, et al. (2007) A candidate gene approach identifies the TRAF1/C5 region as a risk factor for rheumatoid arthritis. PLoS Med 4:e278.
36. International HapMap Consortium (2005) A haplotype map of the human genome. Nature 437:1299-1320.
37. Sokal R R, Rohlf F J. (1995) *Biometry* 3$^{rd}$ ed. W.H. Freeman and Company, United States
38. Clark A G. (2004) The role of haplotypes in candidate gene studies. Genet Epidemiol 27: 321-333.
39. Schaid D J, Rowland C M, Tines D E, Jacobson R M, Poland G A (2002) Score tests for association between traits and haplotypes when linkage phase is ambiguous. Am J Hum Genet. 70:425-434.
40. Yoo J, Seo B, Kim Y (2005) SNPAnalyzer: a web-based integrated workbench for single-nucleotide polymorphism analysis. Nucleic Acids Res 33:W483-W488.
41. Seldin M F, Shigeta R, Villoslada P, Selmi C, Tuomilehto J, et al. (2006) European population substructure: clustering of northern and southern populations. PLoS Genet. 2(9):e143.
42. Sebastiani P, Ramoni M F, Nolan V, Baldwin C T, Steinberg M H (2005) Genetic dissection and prognostic modeling of overt stroke in sickle cell anemia. Nat Genet. 37:435-440.
43. Maller J, George S, Purcell S, Fagerness J, Altshuler D, et al. (2006) Common variation in three genes, including a noncoding variant in CFH, strongly influences risk of age-related macular degeneration. Nat Genet. 38:1055-1059.
44. Shiffman D, Ellis S G, Rowland C M, Malloy M J, Luke M M, et al. (2005) Identification of four gene variants associated with myocardial infarction. Am J Hum Genet. 77:596-605.
45. Grupe A, Abraham R, Li Y, Rowland C, Hollingworth P, et al. (2007) Evidence for novel susceptibility genes for late-onset Alzheimer's disease from a genome-wide association study of putative functional variants. Hum Mol Genet. 16:865-873.
46. Luke M M, Kane J P, Liu D M, Rowland C M, Shiffman D, et al (2007) A polymorphism in the protease-like domain of apolipoprotein(a) is associated with severe coronary artery disease. Arterioscler Thromb Vasc Biol. 27:2030-2036.
47. Huang H, Shiffman M L, Friedman S, Venkatesh R, Bzowej N, et al. (2007) A 7 gene signature identifies the risk of developing cirrhosis in patients with chronic hepatitis C. Hepatology 46(2):297-306.
48. Potter C, Eyre S, Cope A, Worthington J, Barton A. (2007) Investigation of association between the TRAF family genes and RA susceptibility. Ann Rheum Dis. 66:1322-1326.
49. Wang S, Robertson G P, Zhu J (2004) A novel human homologue of *Drosophila* polycomblike gene is up-regulated in multiple cancers. Gene 343:69-78
50. Wang C Y, Mayo M W, Korneluk R G, Goeddel D V, Baldwin A S Jr.(1998) NF-kappaB antiapoptosis: induction of TRAF1 and TRAF2 and c-IAP1 and c-IAP2 to suppress caspase-8 activation. Science 281:1680-1683.
51. Tsitsikov E N, Laouini D, Dunn I F, Sannikova T Y, Davidson L, et al. (2001) TRAF1 is a negative regulator of TNF signaling: enhanced TNF signaling in TRAF1-deficient mice. Immunity 15:647-657.
52. Durkop H, Foss H D, Demel G, Klotzbach H, Hahn C, et al. (1999) Tumor necrosis factor receptor-associated factor 1 is overexpressed in Reed-Sternberg cells of Hodgkin's disease and Epstein-Barr virus-transformed lymphoid cells. Blood 93:617-623
53. Izban K F, Ergin M, Martinez R L, Alkan S (2000) Expression of the tumor necrosis factor receptor-associated factors (TRAFs) 1 and 2 is a characteristic feature of Hodgkin and Reed-Sternberg cells. Mod Pathol 13:1324-1331.
54. Zapata J M, Krajewska M, Krajewski S, Kitada S, Welsh K, et al. (2000) TNFR-associated factor family protein expression in normal tissues and lymphoid malignancies. J Immunol 165:5084-5096.
55. Murray P G, Flavell J R, Baumforth K R, Toomey S M, Lowe D, et al. (2001) Expression of the tumour necrosis factor receptor-associated factors 1 and 2 in Hodgkin's disease. J Pathol 194:158-164.
56. Munzert G, Kirchner D, Stobbe H, Bergmann L, Schmid R M, et al. (2002) Tumor necrosis factor receptor-associated factor 1 gene overexpression in B-cell chronic lymphocytic leukemia: analysis of NF-kappa B/Rel-regulated inhibitors of apoptosis. Blood 100:3749-3756.
57. Savage K J, Monti S, Kutok J L, Cattoretti G, Neuberg D, et al. (2003) The molecular signature of mediastinal large B-cell lymphoma differs from that of other diffuse large B-cell lymphomas and shares features with classical Hodgkin lymphoma. Blood 102:3871-3879.
58. Baecklund E, Iliadou A, Askling J, Ekbom A, Backlin C, et al. (2006) Association of chronic inflammation, not its treatment, with increased lymphoma risk in rheumatoid arthritis. Arthritis Rheum 54:692-701.
59. Kaiser R, et al. Incidence of lymphoma in rheumatoid arthritis: a systematic review of the literature. Clin Lymphoma Myeloma, in press.

60. Youn J, Kim H Y, Park J H, Hwang S H, Lee S Y, et al. (2002) Regulation of TNF-α-mediated hyperplasia through TNF receptors, TRAFs and NF-κB in synoviocytes obtained from patients with rheumatoid arthritis. Immunol Lett 83:85-93.
61. Elliott M J, Maini R N, Feldmann M, Kalden J R, Antoni C, et al. (1994) Randomised double-blind comparison of chimeric monoclonal antibody to tumour necrosis factor alpha (cA2) versus placebo in rheumatoid arthritis. Lancet 344:1105-1110.
62. Weinblatt M E, Kremer J M, Bankhurst A D, Bulpitt K J, Fleischmann R M, et al. (1999) A trial of etanercept, a recombinant tumor necrosis factor receptor:Fc fusion protein, in patients with rheumatoid arthritis receiving methotrexate. N Engl J Med 340:253-259
63. Linton S M, Morgan B P (1999) Complement activation and inhibition in experimental models of arthritis. Mol Immunol 36:905-914.
64. Wang Y, Kristan J, Hao L, Lenkoski C S, Shen Y, et al. (2000) A role for complement in antibody-mediated inflammation: C5-deficient DBA/1 mice are resistant to collagen-induced arthritis. J Immunol 164:4340-4347.
65. Ji H, Gauguier D, Ohmura K, Gonzalez A, Duchatelle V, et al. (2001) Genetic influences on the end-stage effector phase of arthritis. J Exp Med 194:321-330.
66. Wang Y, Rollins S A, Madri J A, Matis L A (1995) Anti-C5 monoclonal antibody therapy prevents collagen-induced arthritis and ameliorates established disease. Proc Natl Acad Sci USA 92: 8955-8959.
67. Ji H, Ohmura K, Mahmood U, Lee D M, Hofhuis F M, et al. (2002) Arthritis critically dependent on innate immune system players. Immunity 16:157-168.
68. Arnett F C, Edworthy S M, Bloch D A, McShane D J, Fries J F, et al. (1988) The American Rheumatism Association 1987 revised criteria for the classification of rheumatoid arthritis. Arthritis Rheum 31:315-324.
69. Jawaheer D, Seldin M F, Amos C I, Chen W V, Shigeta R, et al. (2001) A genomewide screen in multiplex rheumatoid arthritis families suggests genetic overlap with other autoimmune diseases. Am J Hum Genet. 68:927-936.
70. Jawaheer D, Lum R F, Amos C I, Gregersen P K, Criswell L A (2004) Clustering of disease features within 512 multicase rheumatoid arthritis families. Arthritis Rheum 50:736-741.
71. Mitchell M K, Gregersen P K, Johnson S, Parsons R, Vlahov D. (2004) The New York Cancer Project: rationale, organization, design, and baseline characteristics. J Urban Health 81:301-310.
72. Brinkman B M, Huizinga T W, Kurban S S, van der Velde E A, Schreuder G M, et al. (1997) Tumour necrosis factor alpha gene polymorphisms in rheumatoid arthritis: association with susceptibility to, or severity of, disease? Br J Rheumatol 36:516-521.
73. van Aken J, van Bilsen J H, Allaart C F, Huizinga T W, Breedveld F C (2003) The Leiden Early Arthritis Clinic. Clin Exp Rheumatol 21:S100-S105.
74. Koster T, Rosendaal F R, Reitsma P H, van der Velden P A, Briet E, et al. (1994) Factor VII and fibrinogen levels as risk factors for venous thrombosis. A case-control study of plasma levels and DNA polymorphisms—the Leiden Thrombophilia Study (LETS). Thromb Haemost 71:719-722.
75. Bustamante C D, Fledel-Alon A, Williamson S, Nielsen R, Hubisz M T, et al. (2005) Natural selection on protein-coding genes in the human genome. Nature 437:1153-1157.
76. Germer S, Holland M J, Higuchi R. (2000) High-throughput SNP allele-frequency determination in pooled DNA samples by kinetic PCR. Genome Res 10:258-266.
77. Gregersen P K, Silver J, Winchester R J. (1987) The shared epitope hypothesis. An approach to understanding the molecular genetics of susceptibility to rheumatoid arthritis. Arthritis Rheum. 30:1205-1213.
78. Hu X, Schrodi S J, Ross D A, Cargill M (2004) Selecting tagging SNPs for association studies using power calculations from genotype data. Hum Hered 57:156-170.
79. Armitage P (1955) Tests for linear trends in proportions and frequencies. Biometrics 11:375-386.
80. Weir B S (1996) *Genetic Data Analysis II: Methods for Discrete Population Genetic Data*. Sinauer, Sunderland, MA
81. Fisher R A (1954) *Statistical Methods for Research Workers*. 12$^{th}$ ed. Oliver & Boyd, Edinburgh.
82. Mantel N, Haenszel W (1959) Statistical aspects of the analysis of data from retrospective studies of disease. J Natl Cancer Inst. 22:719-748.
83. Abecasis G R, Cookson W O. (2000) GOLD—graphical overview of linkage disequilibrium. Bioinformatics 16:182-183.
84. Breslow N E, Day N E (1980) Statistical methods in cancer research. Vol I. The analysis of case-control studies. International Agency for Research on Cancer, Lyon.
85. Criswell L A, Chen W V, Jawaheer D, Lum R F, Wener M H, et al. (2007) Dissecting the heterogeneity of rheumatoid arthritis through linkage analysis of quantitative traits. Arthritis Rheum 56:58-68.
86. Visser H, Gelinck L B, Kampfraath A H, Breedveld F C, Hazes J M (1996) Diagnostic and prognostic characteristics of the enzyme linked immunosorbent rheumatoid factor assays in rheumatoid arthritis. Ann Rheum Dis. 55:157-161.

Example 2

Linkage Disequilibrium (LD) SNPs Associated with Autoimmune Disease, Particularly Rheumatoid Arthritis Another investigation was conducted to identify additional SNPs that are calculated to be in linkage disequilibrium (LD) with certain "interrogated SNPs" that have been found to be associated with autoimmune disease, particularly RA, as described herein and shown in the tables. The interrogated SNPs are shown in column 1 (which indicates the hCV identification numbers of each interrogated SNP) and column 2 (which indicates the public rs identification numbers of each interrogated SNP) of Table 4. The methodology is described earlier in the instant application. To summarize briefly, the power threshold (T) was set at an appropriate level, such as 51%, for detecting disease association using LD markers. This power threshold is based on equation (31) above, which incorporates allele frequency data from previous disease association studies, the predicted error rate for not detecting truly disease-associated markers, and a significance level of 0.05. Using this power calculation and the sample size, a threshold level of LD, or $r^2$ value, was derived for each interrogated SNP ($r_T^2$, equations (32) and (33) above). The threshold $r_T^2$ value is the minimum value of linkage disequilibrium between the interrogated SNP and its LD SNPs possible such that the non-interrogated SNP still retains a power greater or equal to T for detecting disease association.

Based on the above methodology, LD SNPs were found for the interrogated SNPs. Several exemplary LD SNPs for the interrogated SNPs are listed in Table 4; each LD SNP is associated with its respective interrogated SNP. Also shown are the public SNP IDs (rs numbers) for the interrogated and LD SNPs, when available, and the threshold $r^2$ value and the power used to determine this, and the $r^2$ value of linkage disequilibrium between the interrogated SNP and its corresponding LD SNP. As an example in Table 4, the interrogated SNP rs10435844 (hCV11266229) was calculated to be in LD with rs10760121 (hCV11266268) at an $r^2$ value of 0.9666, based on a 51% power calculation, thus establishing the latter SNP as a marker associated with autoimmune disease as well.

In general, the threshold $r_T^2$ value can be set such that one with ordinary skill in the art would consider that any two SNPs having an $r^2$ value greater than or equal to the threshold $r_T^2$ value would be in sufficient LD with each other such that either SNP is useful for the same utilities, such as determining an individual's risk for autoimmune disease such as RA, for example. For example, in various embodiments, the threshold $r_T^2$ value used to classify SNPs as being in sufficient LD with an interrogated SNP (such that these LD SNPs can be used for the same utilities as the interrogated SNP, for example) can be set at, for example, 0.7, 0.75, 0.8, 0.85, 0.9, 0.95, 0.96, 0.97, 0.98, 0.99, 1, etc. (or any other $r^2$ value in-between these values). Threshold $r_T^2$ values may be utilized with or without considering power or other calculations.

All publications and patents cited in this specification are herein incorporated by reference in their entirety. Modifications and variations of the described compositions, methods and systems of the invention will be apparent to those skilled in the art without departing from the scope and spirit of the invention. Although the invention has been described in connection with specific preferred embodiments and certain working examples, it should be understood that the invention as claimed should not be unduly limited to such specific embodiments. Indeed, various modifications of the above-described modes for carrying out the invention that are obvious to those skilled in the field of molecular biology, genetics and related fields are intended to be within the scope of the following claims.

TABLE 3

| Marker | Alleles | Primer 1 (Allele-specific Primer) | Primer 2 (Allele-specific Primer) | Common Primer |
|---|---|---|---|---|
| hCV11266229 | G/T | GCGGAGACTTCATCCTGATG (SEQ ID NO: 585) | GCGGAGACTTCATCCTGATT (SEQ ID NO: 586) | CCGCTTTGTCTGGATGTGA (SEQ ID NO: 587) |
| hCV11720383 | A/G | TTCCTGACATGCCCCA (SEQ ID NO: 588) | TCCTGACATGCCCCG (SEQ ID NO: 589) | TGTCCCCTGCCTTGACTTAT (SEQ ID NO: 590) |
| hCV11720386 | A/G | GCTTCCCAAAGACTAATGCTA (SEQ ID NO: 591) | GCTTCCCAAAGACTAATGCTG (SEQ ID NO: 592) | GGATAATTTGCAGATCGCCTTCTA (SEQ ID NO: 593) |
| hCV11720394 | A/T | CCTCGGTCATCAATGCTTATAATTA (SEQ ID NO: 594) | CCTCGGTCATCAATGCTTATAATTT (SEQ ID NO: 595) | CAGCACGAATTATTCCAGCTTTCTTTG (SEQ ID NO: 596) |
| hCV11720402 | C/T | TGGGAAATTCAAGGCG (SEQ ID NO: 597) | CTGGGAAATTCAAGGCA (SEQ ID NO: 598) | TTTAAGTCCTGGGTAAACTAAATAGA (SEQ ID NO: 599) |
| hCV11720413 | C/T | GAAAACAGCTTTACAGACAAGC (SEQ ID NO: 600) | GAAAACAGCTTTACAGACAAGT (SEQ ID NO: 601) | GGAAGCCACAGAAGGCATCAG (SEQ ID NO: 602) |
| hCV11720414 | A/G | GCCCAATGAATAATAATCACAAAAGTT (SEQ ID NO: 603) | GCCCAATGAATAATAATCACAAAAGTC (SEQ ID NO: 604) | AGCAATGCTGTGAAGGAGAGATAT (SEQ ID NO: 605) |
| hCV11720421 | A/G | AGAGAAGGTGTGTCCAACA (SEQ ID NO: 606) | GAGAAGGTGTGTCCAACG (SEQ ID NO: 607) | AGAGGTGAGCACTTCGCTCTATC (SEQ ID NO: 608) |
| hCV11840638 | A/G | ACTCCGCAGGCATCAT (SEQ ID NO: 609) | ACTCCGCAGGCATCAC (SEQ ID NO: 610) | GGAAGCAAAGTGAGTGTGAACAATA (SEQ ID NO: 611) |
| hCV1219005 | A/G | CAAACCTGATCACTTTAGGGAA (SEQ ID NO: 612) | CAAACCTGATCACTTTAGGGAG (SEQ ID NO: 613) | GGAGAATGCGGCTCACACTC (SEQ ID NO: 614) |
| hCV1219006 | C/G | GGGAAGTCTTTCTGGATTGTTG (SEQ ID NO: 615) | GGGAAGTCTTTCTGGATTGTTC (SEQ ID NO: 616) | CCATAGCTGCTCTGAAGGGACTG (SEQ ID NO: 617) |
| hCV1434291 | A/G | CTTTTCTGTCTTGCCCAT (SEQ ID NO: 618) | CTTTTCTGTCTTGCCCCAC (SEQ ID NO: 619) | AGGATGGGCTAAGGAATTACTGAAATACC (SEQ ID NO: 620) |
| hCV1434292 | A/C | GCAGAGGAAATCCAGTTATCTT (SEQ ID NO: 621) | GCAGAGGAAATCCAGTTATCTG (SEQ ID NO: 622) | CCGTTCCCCATCAGCTGATTTAC (SEQ ID NO: 623) |
| hCV1452636 | A/G | GCCACACAATCTAGCAATTCT (SEQ ID NO: 624) | GCCACACAATCTAGCAATTCC (SEQ ID NO: 625) | TCATGCTGGTTGGACACTTAGAT (SEQ ID NO: 826) |
| hCV1452662 | A/C | CCAAGGAGTCTACACTCTCAA (SEQ ID NO: 627) | CCAAGGAGTCTACACTCTCAC (SEQ ID NO: 628) | GAGGTGGCATGCAAACACA (SEQ ID NO: 629) |
| hCV15751719 | A/G | GGTTCTTTACTTGCTTCAGTTATTAT (SEQ ID NO: 630) | GGTTCTTTACTTGCTTCAGTTATTAC (SEQ ID NO: 631) | ATGTCCAGGGGATTCAAGAATGAGTA (SEQ ID NO: 632) |

TABLE 3-continued

| Marker | Alleles | Primer 1 (Allele-specific Primer) | Primer 2 (Allele-specific Primer) | Common Primer |
|---|---|---|---|---|
| hCV15757738 | A/T | CCACCACTGGCCTATGAT (SEQ ID NO: 632) | CCACCACTGGCCTATGAA (SEQ ID NO: 633) | GTAATGTGCTTTACCTCAGTTAGAAC (SEQ ID NO: 635) |
| hCV15849105 | A/G | GCCAGTCTTGGATTCATCTTATATACTA (SEQ ID NO: 635) | CCAGTCTTGGATTCATCTTATATACTG (SEQ ID NO: 634) | AGCGAGGCTCCGTCTCAA (SEQ ID NO: 638) |
| hCV15849916 | C/T | TCAGCCTTAGAACAATGCTATG (SEQ ID NO: 638) | GTCAGCCTTAGAACAATGCTATA (SEQ ID NO: 637) | GCTCTGTCCCAAGATTTTCTGTT (SEQ ID NO: 641) |
| hCV15870898 | C/T | GGAGCTCCCCATTTTGG (SEQ ID NO: 641) | AGGAGCTCCCCATTTTGA (SEQ ID NO: 640) | CCACTAGCCAGGCAGGATAAGAT (SEQ ID NO: 644) |
| hCV15875924 | A/T | ACTGCTCAGTGTCTTTCCAA (SEQ ID NO: 644) | ACTGCTCAGTGTCTTTCCAT (SEQ ID NO: 643) | CCTGGGGAGCTCTGAGTGAT (SEQ ID NO: 647) |
| hCV15875965 | A/T | CTTTTGCAAGTGAGGCATAGA (SEQ ID NO: 647) | TTTTGCAAGTGAGGCATAGT (SEQ ID NO: 646) | GCTGCTCCGTGGAGTAACTC (SEQ ID NO: 650) |
| hCV15974495 | C/T | ACAGAATGATGTAGCTGTCG (SEQ ID NO: 650) | TACAGAATGATGTAGCTGTCA (SEQ ID NO: 649) | TCCTGCAGATCTGGAGAATC (SEQ ID NO: 653) |
| hCV18077967 | C/T | AACACATTTGAGTGGGTACAC (SEQ ID NO: 653) | AAACACATTTGAGTGGGTACAT (SEQ ID NO: 652) | CTGACACACCATCCTCATTGGTTTAG (SEQ ID NO: 656) |
| hCV16175379 | A/G | CCATACCTTGTTCCGGAAA (SEQ ID NO: 656) | CCATACCTTGTTCCGGAAG (SEQ ID NO: 655) | AATGGAGATGGCACTGGAAAGAGA (SEQ ID NO: 659) |
| hCV16234785 | C/T | TGCCTCAAGTGCTTTACG (SEQ ID NO: 659) | GTGCCTCAAGTGCTTTACA (SEQ ID NO: 658) | AACGTCAGCCTCCAGTGACTACTTT (SEQ ID NO: 662) |
| hCV16234795 | C/G | CTTGGGAAAGTCATTAGTACAAAC (SEQ ID NO: 662) | CTTGGGAAAGTCATTAGTACAAAG (SEQ ID NO: 661) | TCCTTCAAGGTAAGCATCTGAGTGT (SEQ ID NO: 665) |
| hCV1632189 | G/T | GGGAAATCTTGTTGGATAGTCTG (SEQ ID NO: 665) | GGGAAATCTTGTTGGATAGTCTT (SEQ ID NO: 664) | GCAGCTCTCCTTGACTAGGAGTAAT (SEQ ID NO: 668) |
| hCV1632190 | C/T | TTCTGATGACTGATCAAACAGAC (SEQ ID NO: 668) | TTCTGATGACTGATCAAACAGAT (SEQ ID NO: 667) | GCTGAGATTCAGTACTTCAAGTTTAACACAT (SEQ ID NO: 671) |
| hCV1761888 | C/T | TGCCCTTTATTTACATGACG (SEQ ID NO: 671) | GTGCCCTTTATTTACATGACA (SEQ ID NO: 670) | AAAAGGCAATTCACAAAGAG (SEQ ID NO: 674) |
| hCV1761894 | A/G | CCTATGGAGATATGAACTGGTAAAAT (SEQ ID NO: 674) | CCTATGGAGATATGAACTGGTAAAAC (SEQ ID NO: 673) | ACGAGTGGAGTCATTGAATTGTAGCTA (SEQ ID NO: 677) |
| hCV1917481 | C/T | TCTCAGTGCAAACTGTTCAAC (SEQ ID NO: 677) | TCTTCAGTGCAAACTGTTCAAT (SEQ ID NO: 676) | CCTTCAGTGCTTCCTCAAAGCTTAAT (SEQ ID NO: 680) |
| hCV22272061 | C/G | GCTAATTGAAAGCTAATGATTCCTTG (SEQ ID NO: 680) | GCTAATTGAAAGCTAATGAATTCCTTC (SEQ ID NO: 679) | ATGGTGTTTCCCGTGCCTCTGTA (SEQ ID NO: 683) |

TABLE 3-continued

| Marker | Alleles | Primer 1 (Allele-specific Primer) | Primer 2 (Allele-specific Primer) | Common Primer |
|---|---|---|---|---|
| hCV22272588 | G/T | TTGAACCCCTGTCAAAGATG (SEQ ID NO: 681) | CATATTGAACCCCTGTCAAAGATT (SEQ ID NO: 682) | CCCACTATGATTGGTGTAGCTGTAGA (SEQ ID NO: 686) |
| hCV25473087 | C/T | GACCAGTTGGTAGGAGGG (SEQ ID NO: 684) | TGACCAGTTGGTAGGAGGA (SEQ ID NO: 685) | CGTTCACTTCCAGATGGAGATTAAG (SEQ ID NO: 689) |
| hCV25612709 | A/G | CAGGTAAGAGATGTTGAAACTGT (SEQ ID NO: 687) | AGGTAAGAGATGTTGAAACTGC (SEQ ID NO: 688) | GGGGAACCACTCAGGATTAGAGA (SEQ ID NO: 692) |
| hCV25751916 | A/C | ACAACCAGATTTGATCATCATCAA (SEQ ID NO: 690) | CAACCAGATTTGATCATCATCAC (SEQ ID NO: 691) | TCTCCTCCTGCTGCCTTCATTCT (SEQ ID NO: 695) |
| hCV25763321 | A/G | CTCCCTCCTGGCTCTCA (SEQ ID NO: 693) | TCCTCCTGGCTCTCG (SEQ ID NO: 694) | CTGGAGCAGAGAACCTGTCAGAC (SEQ ID NO: 698) |
| hCV25766419 | G/T | GGTTCTAACCCCATCTTTCC (SEQ ID NO: 696) | GGTTCTAACCCCATCTTTCA (SEQ ID NO: 697) | CTTGGGCAGTGTAGAAGGCTGAAAC (SEQ ID NO: 701) |
| hCV26144018 | A/G | TCCTCCACTACCCTCAGA (SEQ ID NO: 699) | CCTCCACTACCCTCAGG (SEQ ID NO: 700) | GTCTCCACCTTCACGATGTTTACAT (SEQ ID NO: 704) |
| hCV26144282 | A/T | TCAGGACAAGAATCTCATTTCATT (SEQ ID NO: 702) | TTCAGGACAAGAATCTCATTTCATA (SEQ ID NO: 703) | TATGAGCCTTTCACATACGTGTATTACAGA (SEQ ID NO: 707) |
| hCV26144366 | G/T | GCAAAGAGCTGAGAGAATCC (SEQ ID NO: 705) | GCAAAGAGCTGAGAGAATCA (SEQ ID NO: 706) | GACAGACACAAGGACCATCCCTGATA (SEQ ID NO: 710) |
| hCV2644 | A/C | CTGCAGGTATTTGGGAA (SEQ ID NO: 708) | CTGCAGGTATTTGGGAC (SEQ ID NO: 709) | GTATGGGAAGAGCTTCACCTACTGT (SEQ ID NO: 713) |
| hCV27476319 | A/G | CCAAACTTACCTGGCTGTTTATA (SEQ ID NO: 711) | CAAACTTACCTGGCTGTTTATG (SEQ ID NO: 712) | GTGTTTTGCCTGGGTTTGAAGAAC (SEQ ID NO: 716) |
| hCV2783582 | A/G | CTCATAAGAAGGTCACATGTCAT (SEQ ID NO: 714) | CTCATAAGAAGGTCACATGTCAC (SEQ ID NO: 715) | ATGTATGCCATGCCACTTTTGTCA (SEQ ID NO: 719) |
| hCV2783586 | C/G | TGTTCATTCTGTGTACCTTCAG (SEQ ID NO: 717) | TGTTCATTCTGTGTACCTTCAC (SEQ ID NO: 718) | GGCTATTTCCTGCCATCTCTGTAAAC (SEQ ID NO: 722) |
| hCV2783589 | C/T | GCTTTCAGATAACAGACAAACAC (SEQ ID NO: 720) | AGTTTCAGATAACAGACAAACAT (SEQ ID NO: 721) | CTGATGAGCGGCTTCGGTTAAA (SEQ ID NO: 725) |
| hCV2783590 | C/T | CAATGGGGACAATCTCAGC (SEQ ID NO: 723) | ACAATGGGGACAATCTCAGT (SEQ ID NO: 724) | ATTCATAGATGAGGGTATTTCTGGTGTTGA (SEQ ID NO: 728) |
| hCV2783591 | C/G | CCCTGCTGACACCTTAATC (SEQ ID NO: 726) | CCCTGCTGACACCTTAATG (SEQ ID NO: 727) | CGGGATTAAGGGGACAGTTCTATC (SEQ ID NO: 731) |

TABLE 3-continued

| Marker | Alleles | Primer 1 (Allele-specific Primer) | Primer 2 (Allele-specific Primer) | Common Primer |
|---|---|---|---|---|
| hCV2783597 | G/T | CCACCTCCTAGCTTGTAGAG (SEQ ID NO: 731) | CCACCTCCTAGCTTGTAGAT (SEQ ID NO: 732) | GGGTCTCAGGAGAACTCGATTGT (SEQ ID NO: 734) |
| hCV2783604 | C/T | ACTTAACATCTGTTATCACATTCTG (SEQ ID NO: 735) | CACTTAACATCTGTTATCACATTCTA (SEQ ID NO: 736) | GCACCCGGCCTTGACTT (SEQ ID NO: 737) |
| hCV2783608 | A/T | GTAGTAGGGTCCTGACTTGA (SEQ ID NO: 738) | GTAGTAGGGTCCTGACTTGT (SEQ ID NO: 739) | GAGAGAAGCCTGGGCAATACTG (SEQ ID NO: 740) |
| hCV2783611 | A/G | GGGGAACCTCCGTCTGT (SEQ ID NO: 741) | GGGAACCTCCGTCTGC (SEQ ID NO: 742) | AAAGTTTTGCTTCATCAACTACA (SEQ ID NO: 743) |
| hCV2783618 | C/T | GCCAGCTGACAAACACTG (SEQ ID NO: 744) | GGCCAGCTGACAAACACTA (SEQ ID NO: 745) | CCAAGGTCAGCGCTCAAA (SEQ ID NO: 746) |
| hCV2783620 | C/G | TGCCCCAGATGTGTTTTC (SEQ ID NO: 747) | TGCCCCAGATGTGTTTTG (SEQ ID NO: 748) | TGAGCTGGATTCCTGGTGGATAAG (SEQ ID NO: 749) |
| hCV2783621 | C/T | TGAGTGTGAGAAGGAGATCTG (SEQ ID NO: 750) | CTGAGTGTGAGAAGGAGATCTA (SEQ ID NO: 751) | GCTCTGATGCTTGGGAAAGTCAT (SEQ ID NO: 752) |
| hCV2783625 | A/G | GGAGGTGACCTTGGATTATCT (SEQ ID NO: 753) | GGAGGTGACCTTGGATTATCC (SEQ ID NO: 754) | TTGTGGTCCCCTTCCTCCATCTTC (SEQ ID NO: 755) |
| hCV2783633 | G/T | GTTCCAAGAACATGCATTGG (SEQ ID NO: 756) | AGTTCCAAGAACATGCATTGT (SEQ ID NO: 757) | CTCTGAGCTGGTCCCCTCAT (SEQ ID NO: 758) |
| hCV2783634 | C/G | GAGACCATTATCAGCTCACG (SEQ ID NO: 759) | GAGACCATTATCAGCTCACC (SEQ ID NO: 760) | GAGGGCCAGGGTTCTAAATTGTA (SEQ ID NO: 761) |
| hCV2783638 | C/T | ACTTTCACAGTGGTTTCAGATC (SEQ ID NO: 762) | ACTTTCACAGTGTTTTCAGATT (SEQ ID NO: 763) | CCCAGGGCCCACAGTAGTAA (SEQ ID NO: 764) |
| hCV2783641 | C/G | CTTTTCTTATTAGAGCAGGTTGG (SEQ ID NO: 765) | CTTTTCTTATTAGAGCAGGTTGC (SEQ ID NO: 766) | TCCTTCCCCTGGTTTGGGATAAA (SEQ ID NO: 767) |
| hCV2783653 | A/G | CAACCTGTGAACATGAGAATACT (SEQ ID NO: 768) | AACCTGTGAACATGAGAATACC (SEQ ID NO: 769) | GGTGTGTTGCCTCTATCACATCT (SEQ ID NO: 770) |
| hCV2783655 | A/G | TCCAAGCCTCACTTTGTG (SEQ ID NO: 771) | CCAAGCCTCACTTTGTGC (SEQ ID NO: 772) | CTGCTGTATGAACTTGGGTCTGG (SEQ ID NO: 773) |
| hCV2783683 | G/T | CTTCATCTTGGAATGCTCAAAAG (SEQ ID NO: 774) | CTTCATCTTGGAATGCTCAAAAT (SEQ ID NO: 775) | ACCATTAGACTAGTTAAGATCACTAAGGATGTGA (SEQ ID NO: 776) |
| hCV2783668 | C/T | GGCTACTTGTGAGTTCTTTGG (SEQ ID NO: 777) | GGCTACTTGTGAGTTCTTTGA (SEQ ID NO: 778) | GGTATTTGGCAACTGTAACTTTGTGGA (SEQ ID NO: 779) |

TABLE 3-continued

| Marker | Alleles | Primer 1 (Allele-specific Primer) | Primer 2 (Allele-specific Primer) | Common Primer |
|---|---|---|---|---|
| hCV2783677 | C/T | GGAACAGATGATTCAATGGTCTC (SEQ ID NO: 780) | GGAACAGATGATTCAATGGTCTT (SEQ ID NO: 781) | GTTTCTTACAAGCATAAGGTGCCTTACA (SEQ ID NO: 782) |
| hCV2783678 | C/G | CCAGTAGAGGTAAATGAAGAACTTTG (SEQ ID NO: 783) | CCAGTAGAGGTAAATGAAGAACTTTC (SEQ ID NO: 784) | CTGTTTAGGACATAGCTGACACTCAA (SEQ ID NO: 785) |
| hCV2783699 | C/T | CATGTGCAGGTCTGTTGTAC (SEQ ID NO: 786) | CATGTGCAGGTCTGTTGTAT (SEQ ID NO: 787) | GTGGAGGGTGAGAGAAGGGTAAAG (SEQ ID NO: 788) |
| hCV27912350 | A/G | GCAAATGTAGGACTCTTGATGTTA (SEQ ID NO: 789) | CAAATGTAGGACTCTTGATGTTG (SEQ ID NO: 790) | CGAACAGAGCCTAGCACAAATGTAAAT (SEQ ID NO: 791) |
| hCV27912351 | G/T | GCCTGGGCTTATAAAGG (SEQ ID NO: 792) | GCCTGGGCTTATAAAGT (SEQ ID NO: 793) | GGCAAACAACAGGCAAATGTGA (SEQ ID NO: 794) |
| hCV28010798 | C/G | TGAGGAGACAAAGTGGCTC (SEQ ID NO: 795) | TGAGGAGACAAAGTGGCTG (SEQ ID NO: 796) | AGTGATAGGGAATTGTAGCCGTCTTT (SEQ ID NO: 797) |
| hCV29005933 | C/T | TTGCTTTAACTCCCTTGTAGC (SEQ ID NO: 798) | CTTGCTTTAACTCCCTTGTAGT (SEQ ID NO: 799) | CAGGGCTCGGATGAACCTCAAAG (SEQ ID NO: 800) |
| hCV29005938 | A/G | TGGGTTGAAGCCTCAATTCTA (SEQ ID NO: 801) | GGGTTGAAGCCTCAATTCTG (SEQ ID NO: 802) | CGCAAATTATTGGACAAATGAGGAAACATG (SEQ ID NO: 803) |
| hCV29005938 | C/G | TCCCTTAGCCCTTTAATTGGATTTG (SEQ ID NO: 804) | TCCTTAGCCCTTTAATTGGATTTC (SEQ ID NO: 805) | TTGCAGAGGAATCGGAATCAGGATATT (SEQ ID NO: 806) |
| hCV29005968 | C/T | TCCATACCTCTGTTCGGC (SEQ ID NO: 807) | TTCCATACCTCTGTTCGGT (SEQ ID NO: 808) | TCAGGGCTACGGTGATGTTTCA (SEQ ID NO: 809) |
| hCV29005978 | A/G | AGCTATCCCCTACCGT (SEQ ID NO: 810) | GCTATCCCCCTACCGC (SEQ ID NO: 811) | GACAGGAAATTCCCCTGAACTCT (SEQ ID NO: 812) |
| hCV29005979 | A/T | TGGTCCTACTGTTCCCTACT (SEQ ID NO: 813) | TGGTCCTACTGTTCCCTACA (SEQ ID NO: 814) | GCCCTGTTTCCTTCCTGTGTT (SEQ ID NO: 815) |
| hCV29006006 | A/T | GAGTCAGTCTTTTATGATCACACT (SEQ ID NO: 816) | GAGTCAGTCTTTTATGATCACACA (SEQ ID NO: 817) | GCTGCATTGACTATTGCGAGATATTTG (SEQ ID NO: 818) |
| hCV29752541 | A/G | CTGCACAAGGAGGAACACA (SEQ ID NO: 819) | CTGCACAAGGAGGAACACT (SEQ ID NO: 820) | CGTACTCCAATCTGGGACTAGA (SEQ ID NO: 821) |
| hCV2824827 | C/T | TTGAGCTTTGGGCAAGTC (SEQ ID NO: 822) | TTTGAGCTTTGGGCAAGTT (SEQ ID NO: 823) | TGTGACTCCTCACAACAACTTATCATGT (SEQ ID NO: 824) |
| hCV30167357 | C/G | CTCCTATCCAAGTGTTAACCAG (SEQ ID NO: 825) | TCCTATCCAAGTGTTAACCAC (SEQ ID NO: 826) | TTAGGAGGCTAGCGTAGCAATCTAG (SEQ ID NO: 827) |
| hCV30203282 | C/T | AGCTTAGGAAACACCAAATTAAAC (SEQ ID NO: 828) | ATAAGCTTAGGAAACACCAAATTAAAT (SEQ ID NO: 829) | TTGATGTGTCATAATGTGCGTTAGCAT (SEQ ID NO: 830) |

TABLE 3-continued

| Marker | Alleles | Primer 1 (Allele-specific Primer) | Primer 2 (Allele-specific Primer) | Common Primer |
|---|---|---|---|---|
| hCV30293181 | A/G | GTGGAGCTCACAAAGAGTTAT (SEQ ID NO: 828) | TGGAGCTCACAAAGAGTTAC (SEQ ID NO: 829) | TCCTGTTCTCAACGGCTCAGTT (SEQ ID NO: 830) |
| hCV3045792 | A/G | TTGATCACTAACCTTACTCAGTAAAT (SEQ ID NO: 831) | TGATCACTAACCTTACTCAGTAAAC (SEQ ID NO: 832) | AGCCCTGCAGTAAATGTTAGCCACTAG (SEQ ID NO: 833) |
| hCV3045796 | A/T | GCCTCTTCATTAAAATCATCACATCAT (SEQ ID NO: 834) | GCCTCTTCATTAAAATCATCACATCAA (SEQ ID NO: 835) | GTGACATTGTGTTTCCTTGATTTAGAAGC (SEQ ID NO: 836) |
| hCV3045797 | C/G | ACTACTGTGGCTGTCTGATC (SEQ ID NO: 837) | ACTACTGTGGCTGTCTGATG (SEQ ID NO: 838) | GCTACAGGAGGGGAGACTGATTAC (SEQ ID NO: 839) |
| hCV3045798 | G/T | CTTTATAGGATGCAAATGCTAATGAG (SEQ ID NO: 840) | CTTTATAGGATGCAAATGCTAATGAT (SEQ ID NO: 841) | GGCATCAGAAAGAACAAAGGCTAATT (SEQ ID NO: 842) |
| hCV3045800 | A/T | GGGACTTCATTGATGGAAAATGTA (SEQ ID NO: 843) | GGGACTTCATTGATGGAAAATGTT (SEQ ID NO: 844) | TGAGCGACGTTTCAGAGAGTCTT (SEQ ID NO: 845) |
| hCV3045802 | C/T | GGAGCTGTGACAATCGAG (SEQ ID NO: 846) | GGAGCTGTGACAATCGAA (SEQ ID NO: 847) | ACTGTATGACTCCCTTTATGTACTACAATACATG (SEQ ID NO: 848) |
| hCV3045803 | A/C | GCATGGACATGAGACAGATT (SEQ ID NO: 849) | GCATGGACATGAGACAGATG (SEQ ID NO: 850) | TGCTTGAATCCCCTCCTCACAT (SEQ ID NO: 851) |
| hCV3045812 | C/T | GCAGTCAGTCAGTGCCTATGC (SEQ ID NO: 852) | GGCAGTCAGTCAGTGCCTATGT (SEQ ID NO: 853) | TCCCCTCCACCAAATACAGTACTACTATATTCTACA (SEQ ID NO: 854) |
| hCV30527383 | A/G | AGAGCCTGGTAAAGAAGGT (SEQ ID NO: 855) | GAGCCTGGTAAAGAAGGC (SEQ ID NO: 856) | GGCATCTGCTGGCTGAGT (SEQ ID NO: 857) |
| hCV30563728 | C/T | TGTAATAGTGCATGAAGGACG (SEQ ID NO: 858) | AATGTAATAGTGCATGAAGGACA (SEQ ID NO: 859) | GCAAACCAACATGGCACATGTATAC (SEQ ID NO: 860) |
| hCV30563729 | A/G | CGGTGAGAATGCCATGGA (SEQ ID NO: 861) | CGGTGAGAATGCCATGGT (SEQ ID NO: 862) | AGCCAAATTACCAGAACAGCTAAACTG (SEQ ID NO: 863) |
| hCV30829490 | C/T | TGATTCTCCAATGGTTAAGAGC (SEQ ID NO: 864) | GTGATTCTTCCAATGGTTAAGAGT (SEQ ID NO: 865) | TGTTGGCCAGGCTGGTTTCA (SEQ ID NO: 866) |
| hCV30829528 | G/T | GTAAACCCTACCTAAAATGTACTGG (SEQ ID NO: 867) | GTAAACCCTACCTAAAATGTACTGT (SEQ ID NO: 868) | GAGGGAGATGGAGGGGATGATGAC (SEQ ID NO: 869) |
| hCV30830255 | C/T | TCCTCCTTGTAGTTAACAATGC (SEQ ID NO: 870) | GATATCCTCCTTGTAGTTAACAATGT (SEQ ID NO: 871) | CAGTCTTACATGCTTCAAGAAACTGG (SEQ ID NO: 872) |
| hCV30830340 | C/T | AGTGGGATACTACTGATTTTAGACAAC (SEQ ID NO: 873) | GAAGTGGATACTACTGATTTTAGACAAT (SEQ ID NO: 874) | GGTGTTACTTTGGATCCTAGGGGTATTT (SEQ ID NO: 875) |

TABLE 3-continued

| Marker | Alleles | Primer 1 (Allele-specific Primer) | Primer 2 (Allele-specific Primer) | Common Primer |
|---|---|---|---|---|
| hCV30830341 | A/G | GAAATTCACTTCAGTAAACATGTACT (SEQ ID NO: 879) | GAAATTCACTTCAGTAAACATGTACC (SEQ ID NO: 880) | GGAGGTGATGGAGCCAAGATTC (SEQ ID NO: 881) |
| hCV30830377 | A/G | TACCCCATTTTCCATGATATGATTA (SEQ ID NO: 882) | CCCCATTTTCCATGATATGATTG (SEQ ID NO: 883) | TTTATGTGGGTAAATAGTATTTACGGGGTACAC (SEQ ID NO: 884) |
| hCV30830395 | C/T | TGACCCAGAGTAGAAGCTG (SEQ ID NO: 885) | GTTATGACCCAGAGTAGAAGCTA (SEQ ID NO: 886) | GCCAGCAAGCAAGTAAAGAAATGATT (SEQ ID NO: 887) |
| hCV30830407 | C/G | TGTACACATAACAACTGAGAACTG (SEQ ID NO: 888) | TGTACACATAACAACTGAGAACTC (SEQ ID NO: 889) | CAATAAGCCAATGATGCTGGTACTATCA (SEQ ID NO: 890) |
| hCV30830414 | C/T | CCTGTGTTATGTTCCACCG (SEQ ID NO: 891) | TCCTGTGTTATGTTCCACCA (SEQ ID NO: 892) | GCTGCAACAGCAGGAAAGAGAAT (SEQ ID NO: 893) |
| hCV30830415 | C/T | GGACAGAATTCTGCAGGC (SEQ ID NO: 894) | AGGACAGAATTCTGCAGGT (SEQ ID NO: 895) | CTCAGGACCTCAGACCACTTTAGTTA (SEQ ID NO: 896) |
| hCV30830417 | C/T | GCACTAGACCTTGCCCG (SEQ ID NO: 897) | GCACTAGACCTTGCCCA (SEQ ID NO: 898) | ACTGTTCCCAAGACCATGATCACT (SEQ ID NO: 899) |
| hCV30830435 | A/T | ATCATGATCCGGTCTCTCAT (SEQ ID NO: 900) | TCATGATCCGGTCTCTCAA (SEQ ID NO: 901) | GGAATGGGGCATTTGGCTATATTGT (SEQ ID NO: 902) |
| hCV30830484 | A/G | CATGTCTCATTTACCTCCTTTCT (SEQ ID NO: 903) | CATGTCTCATTTACCTCCTTTCC (SEQ ID NO: 904) | CCCCCTTCCAGTTCTGTGATCATGA (SEQ ID NO: 905) |
| hCV30830503 | G/T | CAACCTCACAGATTTGGAGAC (SEQ ID NO: 906) | CAACCTCACAGATTTGGAGAA (SEQ ID NO: 907) | GTTCTCACAGTAATCTGCTCAACAAACT (SEQ ID NO: 908) |
| hCV30830506 | A/G | AAGGGTCATATTGTCTATTTGAGAT (SEQ ID NO: 909) | AAGGGTCATATTGTCTATTTGAGAC (SEQ ID NO: 910) | CCAGCACTTCCACTGGTTGTT (SEQ ID NO: 911) |
| hCV30830512 | A/G | AGGGGACTTATATGACTTGCAT (SEQ ID NO: 912) | GGGGACTTATATGACTTGCAC (SEQ ID NO: 913) | GCTTACTGTCCACCTGAAGGATTAGA (SEQ ID NO: 914) |
| hCV30830514 | A/G | CATAGAGTATACCATGTTTTGAGACT (SEQ ID NO: 915) | ATAGAGTATACCATGTTTTGAGACC (SEQ ID NO: 916) | GCGGCTATGTGTATTATAGTGTTAAGCATGA (SEQ ID NO: 917) |
| hCV30830536 | G/T | TGCATGAGGTTTACATTCAGATC (SEQ ID NO: 918) | TTGCATGAGGTTTACATTCAGATA (SEQ ID NO: 919) | GAACACTTTAGGAATGGATGGTTTCAACT (SEQ ID NO: 920) |
| hCV30830538 | A/C | GGTATGATGCCCTTGAGAA (SEQ ID NO: 921) | GGTATGATGCCCTTGAGAC (SEQ ID NO: 922) | TTTCCCAACCTGGCCATTGAC (SEQ ID NO: 923) |
| hCV30830539 | C/T | GTGACTTGAGTTTCTCAGGAG (SEQ ID NO: 924) | GTGACTTGAGTTTCTCAGGAA (SEQ ID NO: 925) | CTCATCTTACCACTGATAACACAGTTCT (SEQ ID NO: 926) |

TABLE 3-continued

| Marker | Alleles | Primer 1 (Allele-specific Primer) | Primer 2 (Allele-specific Primer) | Common Primer |
|---|---|---|---|---|
| hCV30830568 | C/T | CAGACGCATGCCACTAC (SEQ ID NO: 927) | ACAGACGCATGCCACTAT (SEQ ID NO: 928) | ACTTGACCCAGAGTTCGAGAATA (SEQ ID NO: 929) |
| hCV30830600 | A/T | AGCAGAAGACTTGATGACCTATTA (SEQ ID NO: 930) | GCAGAAGACTTGATGACCTATTT (SEQ ID NO: 931) | GCCCCAACTGTATTATGCAGTTTGA (SEQ ID NO: 932) |
| hCV30830611 | A/C | GACCCAAACTATTCACATGGAT (SEQ ID NO: 933) | GACCCAAACTATTCACATGGAG (SEQ ID NO: 934) | CCAGAGGTCGCCACTGTTAAC (SEQ ID NO: 935) |
| hCV30830638 | C/T | CATAGTTGTTCTCTCTGATCCTC (SEQ ID NO: 936) | CATAGTTGTTCTCTCTGATCCTT (SEQ ID NO: 937) | TCCTCTCTGCAATCCTCCTCATAG (SEQ ID NO: 938) |
| hCV30830641 | C/T | GGCTCATAACTGTAGTCTTAGC (SEQ ID NO: 939) | TGGCTCATAACTGTAGTCTTAGT (SEQ ID NO: 940) | GCTGCAGTGCATTGGTACAA (SEQ ID NO: 941) |
| hCV30830652 | C/T | AATCTATGGCAGTTGCCC (SEQ ID NO: 942) | GAATCTATGGCAGTTGCCT (SEQ ID NO: 943) | TCTGGGGTGTGTCAAATTGAGAGACAT (SEQ ID NO: 944) |
| hCV30830668 | C/T | GTGTACCATACTTATTCTCCG (SEQ ID NO: 945) | TGTGTACCATACTTATTCTCCA (SEQ ID NO: 946) | GAGATGGTGGTATGGATGGAATGA (SEQ ID NO: 947) |
| hCV30830686 | C/T | ACTGTAGTAGCCCAGTATCAAG (SEQ ID NO: 948) | ACTGTAGTAGCCCAGTATCAAA (SEQ ID NO: 949) | CCAACATAAGGCTAAGGCAAACACT (SEQ ID NO: 950) |
| hCV30830725 | A/T | ATCCTTTTCCCGTAGAATTGAAT (SEQ ID NO: 951) | ATCCTTTTCCCGTAGAATTGAAA (SEQ ID NO: 952) | GAAGATCTCAGGGGCCCTAAGAG (SEQ ID NO: 953) |
| hCV3121923 | A/G | CTCCTAACTGGTCCACTCAT (SEQ ID NO: 954) | TCCTAACTGGTCCACTCAC (SEQ ID NO: 955) | GCTGGGTTTTGATGGGGAAGTAG (SEQ ID NO: 956) |
| hCV578218 | G/T | CCCATACTCCACTAACAAGGAC (SEQ ID NO: 957) | CCCATACTCCACTAACAAGGAA (SEQ ID NO: 958) | CTTGCAGAAATGTCTTAGGGGACTAGT (SEQ ID NO: 959) |
| hCV578219 | C/T | GCCTTTGGGAAACGCC (SEQ ID NO: 960) | GCTTTGGGAAACGCT (SEQ ID NO: 961) | CCACCCCTTTGAATCCCATACTC (SEQ ID NO: 962) |
| hCV578224 | C/T | GGTTTTGCACAAGGCATG (SEQ ID NO: 963) | GGGTTTTGCACAAGGCATA (SEQ ID NO: 964) | GCACATGTCAGGATGAGAAAGATAC (SEQ ID NO: 965) |
| hCV577155 | C/G | GACAGATGAGAAGTCACTTCAAC (SEQ ID NO: 966) | GACAGATGAGAAGTCACTTCAAG (SEQ ID NO: 967) | GCTGGGATTACATGCATGAGTCA (SEQ ID NO: 968) |
| hCV7577254 | C/T | TCCTTATAAAATCAGACAGTTCTGC (SEQ ID NO: 969) | TCCTTATAAAATCAGACAGTTCTGT (SEQ ID NO: 970) | GCCTCAAAGGGAAACAGCCTAAT (SEQ ID NO: 971) |
| hCV7577271 | A/G | TCTTCACAACAGCAGATACCA (SEQ ID NO: 972) | CTTCACAACAGCAGATACCG (SEQ ID NO: 973) | CACCACCCACTTACTAGCTTTGAGTA (SEQ ID NO: 974) |
| hCV7577296 | C/T | TATTTTGGTTTCTTGGCTCATATAAG (SEQ ID NO: 975) | TTATTTTGGTTTCTTGGCTCATATAAA (SEQ ID NO: 976) | AGACCCAGTGATTCCACCAATATCAT (SEQ ID NO: 977) |

TABLE 3-continued

| Marker | Alleles | Primer 1 (Allele-specific Primer) | Primer 2 (Allele-specific Primer) | Common Primer |
|---|---|---|---|---|
| hCV7577317 | C/G | GTAAAATTTAAAAGAACTGAAATGGAAGAG (SEQ ID NO: 975) | GTAAAATTTAAAAGAACTGAAATGGAAGAC (SEQ ID NO: 978) | GAAGAATTATATCACTGCTTCTCATGAATCTCAC (SEQ ID NO: 980) |
| hCV7577337 | A/G | CTCCAGTGTGTCTCATTTGT (SEQ ID NO: 981) | TCCAGTGTGTCTCATTTGC (SEQ ID NO: 982) | GAGATTCAGGGACGGAAAGAAGC (SEQ ID NO: 983) |
| hCV7577344 | A/T | TTCCCTTCCAGATAACATCCA (SEQ ID NO: 984) | TTCCCTTCCAGATAACATCCT (SEQ ID NO: 985) | CTGTAAGGAGCCCTAGGAAGAATTATG (SEQ ID NO: 986) |
| hCV8605400 | A/C | GACTCCAATGTCATGTTCTTTGA (SEQ ID NO: 987) | CTCCAATGTCATGTTCTTTGC (SEQ ID NO: 988) | GTACCCACTCAGGAGCTCTTAGT (SEQ ID NO: 989) |
| hCV8780517 | A/G | GAGACTCCCATCACAGAGT (SEQ ID NO: 990) | AGAGCTCCCATCACAGAGC (SEQ ID NO: 991) | ACCAAACCCATCTCCACTTACAGT (SEQ ID NO: 992) |
| hCV8780962 | A/G | TGGGATGAGCAATCCTGTTAT (SEQ ID NO: 993) | GGGATGAGCAATCCTGTTAC (SEQ ID NO: 994) | ACCTCATTAGGCCTTGTGCTATCT (SEQ ID NO: 995) |
| hCV8780967 | C/T | ACAGCAACCTGAAAGATTACAG (SEQ ID NO: 996) | ACAGCAACCTGAAAGATTACAA (SEQ ID NO: 997) | GTTTTGTGTGTGTGTGTGTGAT (SEQ ID NO: 998) |
| hCV8780973 | A/G | CAAGCATCCTGACTTCATTTAGA (SEQ ID NO: 999) | AAGCATCCTGACTTCATTTAGG (SEQ ID NO: 1000) | GAGACCTTACTTTTAGGACACCGTAGTT (SEQ ID NO: 1001) |
| hDV70729405 | C/T | CTAACCACCAACCTACCACAC (SEQ ID NO: 1002) | CTAACCACCAACCTACCACAT (SEQ ID NO: 1003) | TTGGAACCTTCGATTCTCCAGATCT (SEQ ID NO: 1004) |

TABLE 4

| Interrogated SNP | Interrogated rs | LD SNP | LD SNP rs | Power | Threshold $r^2$ | $r^2$ |
|---|---|---|---|---|---|---|
| hCV11266229 | rs10435844 | hCV11266268 | rs10760121 | 0.51 | 0.411716825 | 0.9666 |
| hCV11266229 | rs10435844 | hCV11720350 | rs2057469 | 0.51 | 0.411716825 | 0.4465 |
| hCV11266229 | rs10435844 | hCV11720413 | rs1930782 | 0.51 | 0.411716825 | 0.6687 |
| hCV11266229 | rs10435844 | hCV11720414 | rs1930781 | 0.51 | 0.411716825 | 1 |
| hCV11266229 | rs10435844 | hCV15849105 | rs2900185 | 0.51 | 0.411716825 | 0.4708 |
| hCV11266229 | rs10435844 | hCV15849116 | rs2900180 | 0.51 | 0.411716825 | 1 |
| hCV11266229 | rs10435844 | hCV15870898 | rs2072438 | 0.51 | 0.411716825 | 0.6467 |
| hCV11266229 | rs10435844 | hCV16124825 | rs2109895 | 0.51 | 0.411716825 | 1 |
| hCV11266229 | rs10435844 | hCV16175379 | rs2239657 | 0.51 | 0.411716825 | 0.9664 |
| hCV11266229 | rs10435844 | hCV16234795 | rs2416804 | 0.51 | 0.411716825 | 0.6341 |
| hCV11266229 | rs10435844 | hCV16234838 | rs2416819 | 0.51 | 0.411716825 | 0.4465 |
| hCV11266229 | rs10435844 | hCV16234840 | rs2416817 | 0.51 | 0.411716825 | 0.4708 |
| hCV11266229 | rs10435844 | hCV1632195 | rs1998505 | 0.51 | 0.411716825 | 0.4708 |
| hCV11266229 | rs10435844 | hCV1761888 | rs1953126 | 0.51 | 0.411716825 | 0.9666 |
| hCV11266229 | rs10435844 | hCV1761891 | rs1930778 | 0.51 | 0.411716825 | 0.9602 |
| hCV11266229 | rs10435844 | hCV1761894 | rs1609810 | 0.51 | 0.411716825 | 0.9609 |
| hCV11266229 | rs10435844 | hCV2359565 | rs1014530 | 0.51 | 0.411716825 | 0.6687 |
| hCV11266229 | rs10435844 | hCV25613469 | rs10760157 | 0.51 | 0.411716825 | 0.4465 |
| hCV11266229 | rs10435844 | hCV25751916 | rs10985070 | 0.51 | 0.411716825 | 0.6467 |
| hCV11266229 | rs10435844 | hCV25771057 | rs10760150 | 0.51 | 0.411716825 | 0.4708 |
| hCV11266229 | rs10435844 | hCV2783582 | rs10818482 | 0.51 | 0.411716825 | 0.6467 |
| hCV11266229 | rs10435844 | hCV2783586 | rs2270231 | 0.51 | 0.411716825 | 0.9666 |
| hCV11266229 | rs10435844 | hCV2783589 | rs881375 | 0.51 | 0.411716825 | 0.9666 |
| hCV11266229 | rs10435844 | hCV2783590 | rs6478486 | 0.51 | 0.411716825 | 0.9666 |
| hCV11266229 | rs10435844 | hCV2783591 | rs1468671 | 0.51 | 0.411716825 | 1 |
| hCV11266229 | rs10435844 | hCV2783593 | rs1548783 | 0.51 | 0.411716825 | 1 |
| hCV11266229 | rs10435844 | hCV2783597 | rs1860824 | 0.51 | 0.411716825 | 1 |
| hCV11266229 | rs10435844 | hCV2783599 | rs7046108 | 0.51 | 0.411716825 | 1 |
| hCV11266229 | rs10435844 | hCV2783604 | rs10760126 | 0.51 | 0.411716825 | 0.6875 |
| hCV11266229 | rs10435844 | hCV2783607 | rs9886724 | 0.51 | 0.411716825 | 0.6785 |
| hCV11266229 | rs10435844 | hCV2783608 | rs4836834 | 0.51 | 0.411716825 | 0.6687 |
| hCV11266229 | rs10435844 | hCV2783609 | rs2241003 | 0.51 | 0.411716825 | 0.9321 |
| hCV11266229 | rs10435844 | hCV2783611 | rs10435843 | 0.51 | 0.411716825 | 1 |
| hCV11266229 | rs10435844 | hCV2783618 | rs2239658 | 0.51 | 0.411716825 | 1 |
| hCV11266229 | rs10435844 | hCV2783620 | rs7021880 | 0.51 | 0.411716825 | 0.9301 |
| hCV11266229 | rs10435844 | hCV2783621 | rs2416805 | 0.51 | 0.411716825 | 1 |
| hCV11266229 | rs10435844 | hCV2783622 | rs758959 | 0.51 | 0.411716825 | 1 |
| hCV11266229 | rs10435844 | hCV2783625 | rs10118357 | 0.51 | 0.411716825 | 0.6645 |
| hCV11266229 | rs10435844 | hCV2783630 | rs2269060 | 0.51 | 0.411716825 | 0.6687 |
| hCV11266229 | rs10435844 | hCV2783633 | rs7021049 | 0.51 | 0.411716825 | 0.6687 |
| hCV11266229 | rs10435844 | hCV2783634 | rs1014529 | 0.51 | 0.411716825 | 1 |
| hCV11266229 | rs10435844 | hCV2783635 | rs1930780 | 0.51 | 0.411716825 | 1 |
| hCV11266229 | rs10435844 | hCV2783638 | rs3761846 | 0.51 | 0.411716825 | 0.6687 |
| hCV11266229 | rs10435844 | hCV2783640 | rs3761847 | 0.51 | 0.411716825 | 0.6341 |
| hCV11266229 | rs10435844 | hCV2783641 | rs2416806 | 0.51 | 0.411716825 | 1 |
| hCV11266229 | rs10435844 | hCV2783647 | rs10739580 | 0.51 | 0.411716825 | 1 |
| hCV11266229 | rs10435844 | hCV2783650 | rs10760129 | 0.51 | 0.411716825 | 0.6687 |
| hCV11266229 | rs10435844 | hCV2783653 | rs10760130 | 0.51 | 0.411716825 | 0.6687 |
| hCV11266229 | rs10435844 | hCV2783655 | rs10818488 | 0.51 | 0.411716825 | 0.6687 |
| hCV11266229 | rs10435844 | hCV2783656 | rs4837804 | 0.51 | 0.411716825 | 0.8956 |
| hCV11266229 | rs10435844 | hCV2783659 | rs7039505 | 0.51 | 0.411716825 | 1 |
| hCV11266229 | rs10435844 | hCV27912350 | rs4837808 | 0.51 | 0.411716825 | 0.4708 |
| hCV11266229 | rs10435844 | hCV27912351 | rs4837809 | 0.51 | 0.411716825 | 0.4708 |
| hCV11266229 | rs10435844 | hCV29005923 | rs6478494 | 0.51 | 0.411716825 | 0.4238 |
| hCV11266229 | rs10435844 | hCV29005924 | rs7031128 | 0.51 | 0.411716825 | 0.4264 |
| hCV11266229 | rs10435844 | hCV29005976 | rs7037195 | 0.51 | 0.411716825 | 0.6687 |
| hCV11266229 | rs10435844 | hCV29005978 | rs7021206 | 0.51 | 0.411716825 | 1 |
| hCV11266229 | rs10435844 | hCV29006006 | rs7034390 | 0.51 | 0.411716825 | 0.9666 |
| hCV11266229 | rs10435844 | hCV30059070 | rs10156413 | 0.51 | 0.411716825 | 0.5258 |
| hCV11266229 | rs10435844 | hCV3045792 | rs6478499 | 0.51 | 0.411716825 | 0.4879 |
| hCV11266229 | rs10435844 | hCV3045801 | rs2057465 | 0.51 | 0.411716825 | 0.4332 |
| hCV11266229 | rs10435844 | hCV30563729 | rs9299273 | 0.51 | 0.411716825 | 0.4708 |
| hCV11266229 | rs10435844 | hCV30830414 | rs7871371 | 0.51 | 0.411716825 | 0.417 |
| hCV11266229 | rs10435844 | hCV30830468 | rs10818507 | 0.51 | 0.411716825 | 0.4539 |
| hCV11266229 | rs10435844 | hCV30830473 | rs7036649 | 0.51 | 0.411716825 | 0.4705 |
| hCV11266229 | rs10435844 | hCV30830475 | rs10733652 | 0.51 | 0.411716825 | 0.4269 |
| hCV11266229 | rs10435844 | hCV30830484 | rs10818508 | 0.51 | 0.411716825 | 0.4708 |
| hCV11266229 | rs10435844 | hCV30830486 | rs10760149 | 0.51 | 0.411716825 | 0.4708 |
| hCV11266229 | rs10435844 | hCV30830503 | rs4837811 | 0.51 | 0.411716825 | 0.4708 |
| hCV11266229 | rs10435844 | hCV30830512 | rs10818512 | 0.51 | 0.411716825 | 0.4465 |
| hCV11266229 | rs10435844 | hCV30830521 | rs10818513 | 0.51 | 0.411716825 | 0.4465 |
| hCV11266229 | rs10435844 | hCV30830536 | rs7047038 | 0.51 | 0.411716825 | 0.4465 |
| hCV11266229 | rs10435844 | hCV30830638 | rs10985073 | 0.51 | 0.411716825 | 0.6467 |
| hCV11266229 | rs10435844 | hCV30830725 | rs7864019 | 0.51 | 0.411716825 | 1 |
| hCV11266229 | rs10435844 | hCV30830832 | rs10733648 | 0.51 | 0.411716825 | 1 |
| hCV11266229 | rs10435844 | hCV30830909 | rs11794516 | 0.51 | 0.411716825 | 0.6467 |
| hCV11266229 | rs10435844 | hCV7577250 | rs942153 | 0.51 | 0.411716825 | 0.4465 |

TABLE 4-continued

| Interrogated SNP | Interrogated rs | LD SNP | LD SNP rs | Power | Threshold r² | r² |
|---|---|---|---|---|---|---|
| hCV11266229 | rs10435844 | hCV7577271 | rs1535655 | 0.51 | 0.411716825 | 0.4465 |
| hCV11266229 | rs10435844 | hCV7577287 | rs1323478 | 0.51 | 0.411716825 | 0.4708 |
| hCV11266229 | rs10435844 | hCV7577296 | rs1407910 | 0.51 | 0.411716825 | 0.4708 |
| hCV11266229 | rs10435844 | hCV7577344 | rs876445 | 0.51 | 0.411716825 | 1 |
| hCV11720383 | rs1951784 | hCV11720402 | rs17611 | 0.51 | 0.849855381 | 0.9293 |
| hCV11720383 | rs1951784 | hCV15751718 | rs2296078 | 0.51 | 0.849855381 | 0.9649 |
| hCV11720383 | rs1951784 | hCV15755658 | rs2300934 | 0.51 | 0.849855381 | 0.8947 |
| hCV11720383 | rs1951784 | hCV16234785 | rs2416811 | 0.51 | 0.849855381 | 0.9293 |
| hCV11720383 | rs1951784 | hCV1632190 | rs10760146 | 0.51 | 0.849855381 | 1 |
| hCV11720383 | rs1951784 | hCV2359571 | rs25681 | 0.51 | 0.849855381 | 0.9293 |
| hCV11720383 | rs1951784 | hCV25968825 | rs10818504 | 0.51 | 0.849855381 | 1 |
| hCV11720383 | rs1951784 | hCV26144282 | rs10818499 | 0.51 | 0.849855381 | 0.9293 |
| hCV11720383 | rs1951784 | hCV26144291 | rs4570235 | 0.51 | 0.849855381 | 0.9293 |
| hCV11720383 | rs1951784 | hCV26144296 | rs10760143 | 0.51 | 0.849855381 | 1 |
| hCV11720383 | rs1951784 | hCV27476319 | rs3747843 | 0.51 | 0.849855381 | 0.9649 |
| hCV11720383 | rs1951784 | hCV2783711 | rs10733650 | 0.51 | 0.849855381 | 0.9293 |
| hCV11720383 | rs1951784 | hCV29005933 | rs7042135 | 0.51 | 0.849855381 | 0.8947 |
| hCV11720383 | rs1951784 | hCV29005936 | rs6478498 | 0.51 | 0.849855381 | 0.8947 |
| hCV11720383 | rs1951784 | hCV29734592 | rs10435889 | 0.51 | 0.849855381 | 0.9272 |
| hCV11720383 | rs1951784 | hCV29824827 | rs9657673 | 0.51 | 0.849855381 | 1 |
| hCV11720383 | rs1951784 | hCV30041036 | rs10156476 | 0.51 | 0.849855381 | 1 |
| hCV11720383 | rs1951784 | hCV30167357 | rs7022941 | 0.51 | 0.849855381 | 1 |
| hCV11720383 | rs1951784 | hCV3045797 | rs7036541 | 0.51 | 0.849855381 | 1 |
| hCV11720383 | rs1951784 | hCV3045800 | rs3736855 | 0.51 | 0.849855381 | 1 |
| hCV11720383 | rs1951784 | hCV3045804 | rs2057467 | 0.51 | 0.849855381 | 0.9484 |
| hCV11720383 | rs1951784 | hCV3045808 | rs10818516 | 0.51 | 0.849855381 | 0.9294 |
| hCV11720383 | rs1951784 | hCV3045810 | rs2209076 | 0.51 | 0.849855381 | 0.9314 |
| hCV11720383 | rs1951784 | hCV30830415 | rs7855998 | 0.51 | 0.849855381 | 0.8947 |
| hCV11720383 | rs1951784 | hCV30830427 | rs10760142 | 0.51 | 0.849855381 | 0.8947 |
| hCV11720383 | rs1951784 | hCV30830440 | rs10760144 | 0.51 | 0.849855381 | 1 |
| hCV11720383 | rs1951784 | hCV30830506 | rs10760151 | 0.51 | 0.849855381 | 1 |
| hCV11720383 | rs1951784 | hCV30830537 | rs10818515 | 0.51 | 0.849855381 | 0.9646 |
| hCV11720383 | rs1951784 | hCV30830539 | rs10760153 | 0.51 | 0.849855381 | 0.9642 |
| hCV11720383 | rs1951784 | hCV30830540 | rs10760154 | 0.51 | 0.849855381 | 0.9649 |
| hCV11720383 | rs1951784 | hCV30830541 | rs10760155 | 0.51 | 0.849855381 | 0.9649 |
| hCV11720383 | rs1951784 | hCV30830542 | rs10760156 | 0.51 | 0.849855381 | 0.9628 |
| hCV11720383 | rs1951784 | hCV7577235 | rs1052508 | 0.51 | 0.849855381 | 0.9649 |
| hCV11720383 | rs1951784 | hCV7577248 | rs1359086 | 0.51 | 0.849855381 | 0.9314 |
| hCV11720383 | rs1951784 | hCV7577249 | rs1359085 | 0.51 | 0.849855381 | 0.9649 |
| hCV11720383 | rs1951784 | hCV7577337 | rs993247 | 0.51 | 0.849855381 | 0.9293 |
| hCV11720402 | rs17611 | hCV11720383 | rs1951784 | 0.51 | 0.853213654 | 0.9293 |
| hCV11720402 | rs17611 | hCV15751718 | rs2296078 | 0.51 | 0.853213654 | 0.8957 |
| hCV11720402 | rs17611 | hCV15755658 | rs2300934 | 0.51 | 0.853213654 | 0.9646 |
| hCV11720402 | rs17611 | hCV16234785 | rs2416811 | 0.51 | 0.853213654 | 1 |
| hCV11720402 | rs17611 | hCV1632190 | rs10760146 | 0.51 | 0.853213654 | 0.9293 |
| hCV11720402 | rs17611 | hCV2359571 | rs25681 | 0.51 | 0.853213654 | 1 |
| hCV11720402 | rs17611 | hCV25968825 | rs10818504 | 0.51 | 0.853213654 | 0.9293 |
| hCV11720402 | rs17611 | hCV26144282 | rs10818499 | 0.51 | 0.853213654 | 1 |
| hCV11720402 | rs17611 | hCV26144291 | rs4570235 | 0.51 | 0.853213654 | 1 |
| hCV11720402 | rs17611 | hCV26144296 | rs10760143 | 0.51 | 0.853213654 | 0.9279 |
| hCV11720402 | rs17611 | hCV27476319 | rs3747843 | 0.51 | 0.853213654 | 0.8957 |
| hCV11720402 | rs17611 | hCV2783711 | rs10733650 | 0.51 | 0.853213654 | 1 |
| hCV11720402 | rs17611 | hCV29005933 | rs7042135 | 0.51 | 0.853213654 | 0.9646 |
| hCV11720402 | rs17611 | hCV29005936 | rs6478498 | 0.51 | 0.853213654 | 0.9646 |
| hCV11720402 | rs17611 | hCV29734592 | rs10435889 | 0.51 | 0.853213654 | 1 |
| hCV11720402 | rs17611 | hCV29824827 | rs9657673 | 0.51 | 0.853213654 | 0.9251 |
| hCV11720402 | rs17611 | hCV30041036 | rs10156476 | 0.51 | 0.853213654 | 0.9286 |
| hCV11720402 | rs17611 | hCV30167357 | rs7022941 | 0.51 | 0.853213654 | 0.9642 |
| hCV11720402 | rs17611 | hCV3045797 | rs7036541 | 0.51 | 0.853213654 | 0.9272 |
| hCV11720402 | rs17611 | hCV3045800 | rs3736855 | 0.51 | 0.853213654 | 0.9293 |
| hCV11720402 | rs17611 | hCV3045808 | rs10818516 | 0.51 | 0.853213654 | 0.8595 |
| hCV11720402 | rs17611 | hCV3045810 | rs2209076 | 0.51 | 0.853213654 | 0.8635 |
| hCV11720402 | rs17611 | hCV30830340 | rs10760134 | 0.51 | 0.853213654 | 0.8956 |
| hCV11720402 | rs17611 | hCV30830341 | rs7040033 | 0.51 | 0.853213654 | 0.8956 |
| hCV11720402 | rs17611 | hCV30830415 | rs7855998 | 0.51 | 0.853213654 | 0.9646 |
| hCV11720402 | rs17611 | hCV30830427 | rs10760142 | 0.51 | 0.853213654 | 0.9646 |
| hCV11720402 | rs17611 | hCV30830440 | rs10760144 | 0.51 | 0.853213654 | 0.9293 |
| hCV11720402 | rs17611 | hCV30830506 | rs10760151 | 0.51 | 0.853213654 | 0.9293 |
| hCV11720402 | rs17611 | hCV30830537 | rs10818515 | 0.51 | 0.853213654 | 0.8946 |
| hCV11720402 | rs17611 | hCV30830539 | rs10760153 | 0.51 | 0.853213654 | 0.9287 |
| hCV11720402 | rs17611 | hCV30830540 | rs10760154 | 0.51 | 0.853213654 | 0.8956 |
| hCV11720402 | rs17611 | hCV30830541 | rs10760155 | 0.51 | 0.853213654 | 0.8957 |
| hCV11720402 | rs17611 | hCV30830542 | rs10760156 | 0.51 | 0.853213654 | 0.8894 |
| hCV11720402 | rs17611 | hCV7577235 | rs1052508 | 0.51 | 0.853213654 | 0.8957 |
| hCV11720402 | rs17611 | hCV7577248 | rs1359086 | 0.51 | 0.853213654 | 0.8635 |
| hCV11720402 | rs17611 | hCV7577249 | rs1359085 | 0.51 | 0.853213654 | 0.8957 |
| hCV11720402 | rs17611 | hCV7577337 | rs993247 | 0.51 | 0.853213654 | 1 |

TABLE 4-continued

| Interrogated SNP | Interrogated rs | LD SNP | LD SNP rs | Power | Threshold r² | r² |
|---|---|---|---|---|---|---|
| hCV11720413 | rs1930782 | hCV11266229 | rs10435844 | 0.51 | 0.320507332 | 0.6687 |
| hCV11720413 | rs1930782 | hCV11266268 | rs10760121 | 0.51 | 0.320507332 | 0.6344 |
| hCV11720413 | rs1930782 | hCV11720351 | rs1885995 | 0.51 | 0.320507332 | 0.472 |
| hCV11720413 | rs1930782 | hCV11720402 | rs17611 | 0.51 | 0.320507332 | 0.3301 |
| hCV11720413 | rs1930782 | hCV11720414 | rs1930781 | 0.51 | 0.320507332 | 0.6687 |
| hCV11720413 | rs1930782 | hCV1452630 | rs10818476 | 0.51 | 0.320507332 | 0.3495 |
| hCV11720413 | rs1930782 | hCV1452651 | rs3793638 | 0.51 | 0.320507332 | 0.3281 |
| hCV11720413 | rs1930782 | hCV1452652 | rs1060817 | 0.51 | 0.320507332 | 0.3281 |
| hCV11720413 | rs1930782 | hCV1452665 | rs4837796 | 0.51 | 0.320507332 | 0.3495 |
| hCV11720413 | rs1930782 | hCV15751717 | rs2296077 | 0.51 | 0.320507332 | 0.4129 |
| hCV11720413 | rs1930782 | hCV15751719 | rs2146838 | 0.51 | 0.320507332 | 0.472 |
| hCV11720413 | rs1930782 | hCV15757738 | rs2302498 | 0.51 | 0.320507332 | 0.4266 |
| hCV11720413 | rs1930782 | hCV15849116 | rs2900180 | 0.51 | 0.320507332 | 0.6587 |
| hCV11720413 | rs1930782 | hCV15870898 | rs2072438 | 0.51 | 0.320507332 | 0.9671 |
| hCV11720413 | rs1930782 | hCV16124825 | rs2109895 | 0.51 | 0.320507332 | 0.6687 |
| hCV11720413 | rs1930782 | hCV16175379 | rs2239657 | 0.51 | 0.320507332 | 0.6463 |
| hCV11720413 | rs1930782 | hCV16234785 | rs2416811 | 0.51 | 0.320507332 | 0.3301 |
| hCV11720413 | rs1930782 | hCV16234795 | rs2416804 | 0.51 | 0.320507332 | 0.9672 |
| hCV11720413 | rs1930782 | hCV1761881 | rs3933326 | 0.51 | 0.320507332 | 0.3254 |
| hCV11720413 | rs1930782 | hCV1761888 | rs1953126 | 0.51 | 0.320507332 | 0.6344 |
| hCV11720413 | rs1930782 | hCV1761891 | rs1930778 | 0.51 | 0.320507332 | 0.5775 |
| hCV11720413 | rs1930782 | hCV1761894 | rs1609810 | 0.51 | 0.320507332 | 0.6068 |
| hCV11720413 | rs1930782 | hCV22272588 | rs10760117 | 0.51 | 0.320507332 | 0.3495 |
| hCV11720413 | rs1930782 | hCV2359565 | rs1014530 | 0.51 | 0.320507332 | 1 |
| hCV11720413 | rs1930782 | hCV2359571 | rs25681 | 0.51 | 0.320507332 | 0.3301 |
| hCV11720413 | rs1930782 | hCV25751916 | rs10985070 | 0.51 | 0.320507332 | 0.9671 |
| hCV11720413 | rs1930782 | hCV26144282 | rs10818499 | 0.51 | 0.320507332 | 0.3301 |
| hCV11720413 | rs1930782 | hCV26144291 | rs4570235 | 0.51 | 0.320507332 | 0.3301 |
| hCV11720413 | rs1930782 | hCV26144307 | rs1016468 | 0.51 | 0.320507332 | 0.472 |
| hCV11720413 | rs1930782 | hCV26144332 | rs4837813 | 0.51 | 0.320507332 | 0.4513 |
| hCV11720413 | rs1930782 | hCV2783582 | rs10818482 | 0.51 | 0.320507332 | 0.9671 |
| hCV11720413 | rs1930782 | hCV2783586 | rs2270231 | 0.51 | 0.320507332 | 0.6344 |
| hCV11720413 | rs1930782 | hCV2783589 | rs881375 | 0.51 | 0.320507332 | 0.6344 |
| hCV11720413 | rs1930782 | hCV2783590 | rs6478486 | 0.51 | 0.320507332 | 0.6344 |
| hCV11720413 | rs1930782 | hCV2783591 | rs1468671 | 0.51 | 0.320507332 | 0.6687 |
| hCV11720413 | rs1930782 | hCV2783593 | rs1548783 | 0.51 | 0.320507332 | 0.6645 |
| hCV11720413 | rs1930782 | hCV2783597 | rs1860824 | 0.51 | 0.320507332 | 0.6581 |
| hCV11720413 | rs1930782 | hCV2783599 | rs7046108 | 0.51 | 0.320507332 | 0.6687 |
| hCV11720413 | rs1930782 | hCV2783604 | rs10760126 | 0.51 | 0.320507332 | 1 |
| hCV11720413 | rs1930782 | hCV2783607 | rs9886724 | 0.51 | 0.320507332 | 1 |
| hCV11720413 | rs1930782 | hCV2783608 | rs4836834 | 0.51 | 0.320507332 | 1 |
| hCV11720413 | rs1930782 | hCV2783609 | rs2241003 | 0.51 | 0.320507332 | 0.7074 |
| hCV11720413 | rs1930782 | hCV2783611 | rs10435843 | 0.51 | 0.320507332 | 0.6687 |
| hCV11720413 | rs1930782 | hCV2783618 | rs2239658 | 0.51 | 0.320507332 | 0.6687 |
| hCV11720413 | rs1930782 | hCV2783620 | rs7021880 | 0.51 | 0.320507332 | 0.6088 |
| hCV11720413 | rs1930782 | hCV2783621 | rs2416805 | 0.51 | 0.320507332 | 0.6687 |
| hCV11720413 | rs1930782 | hCV2783622 | rs758959 | 0.51 | 0.320507332 | 0.6687 |
| hCV11720413 | rs1930782 | hCV2783625 | rs10118357 | 0.51 | 0.320507332 | 1 |
| hCV11720413 | rs1930782 | hCV2783630 | rs2269060 | 0.51 | 0.320507332 | 1 |
| hCV11720413 | rs1930782 | hCV2783633 | rs7021049 | 0.51 | 0.320507332 | 1 |
| hCV11720413 | rs1930782 | hCV2783634 | rs1014529 | 0.51 | 0.320507332 | 0.6687 |
| hCV11720413 | rs1930782 | hCV2783635 | rs1930780 | 0.51 | 0.320507332 | 0.6687 |
| hCV11720413 | rs1930782 | hCV2783638 | rs3761846 | 0.51 | 0.320507332 | 1 |
| hCV11720413 | rs1930782 | hCV2783640 | rs3761847 | 0.51 | 0.320507332 | 0.9672 |
| hCV11720413 | rs1930782 | hCV2783641 | rs2416806 | 0.51 | 0.320507332 | 0.6594 |
| hCV11720413 | rs1930782 | hCV2783647 | rs10739580 | 0.51 | 0.320507332 | 0.6687 |
| hCV11720413 | rs1930782 | hCV2783650 | rs10760129 | 0.51 | 0.320507332 | 1 |
| hCV11720413 | rs1930782 | hCV2783653 | rs10760130 | 0.51 | 0.320507332 | 1 |
| hCV11720413 | rs1930782 | hCV2783655 | rs10818488 | 0.51 | 0.320507332 | 1 |
| hCV11720413 | rs1930782 | hCV2783656 | rs4837804 | 0.51 | 0.320507332 | 0.775 |
| hCV11720413 | rs1930782 | hCV2783659 | rs7039505 | 0.51 | 0.320507332 | 0.6562 |
| hCV11720413 | rs1930782 | hCV2783711 | rs10733650 | 0.51 | 0.320507332 | 0.3723 |
| hCV11720413 | rs1930782 | hCV2783718 | rs10818500 | 0.51 | 0.320507332 | 0.6661 |
| hCV11720413 | rs1930782 | hCV29005955 | rs7036980 | 0.51 | 0.320507332 | 0.4056 |
| hCV11720413 | rs1930782 | hCV29005976 | rs7037195 | 0.51 | 0.320507332 | 1 |
| hCV11720413 | rs1930782 | hCV29005978 | rs7021206 | 0.51 | 0.320507332 | 0.7031 |
| hCV11720413 | rs1930782 | hCV29006006 | rs7034390 | 0.51 | 0.320507332 | 0.6344 |
| hCV11720413 | rs1930782 | hCV29879049 | rs9792437 | 0.51 | 0.320507332 | 0.4468 |
| hCV11720413 | rs1930782 | hCV3045812 | rs7030849 | 0.51 | 0.320507332 | 0.4468 |
| hCV11720413 | rs1930782 | hCV30829523 | rs12343516 | 0.51 | 0.320507332 | 0.3281 |
| hCV11720413 | rs1930782 | hCV30830319 | rs7037673 | 0.51 | 0.320507332 | 0.517 |
| hCV11720413 | rs1930782 | hCV30830325 | rs10818494 | 0.51 | 0.320507332 | 0.4154 |
| hCV11720413 | rs1930782 | hCV30830340 | rs10760134 | 0.51 | 0.320507332 | 0.3949 |
| hCV11720413 | rs1930782 | hCV30830341 | rs7040033 | 0.51 | 0.320507332 | 0.3949 |
| hCV11720413 | rs1930782 | hCV30830419 | rs10985140 | 0.51 | 0.320507332 | 0.6317 |
| hCV11720413 | rs1930782 | hCV30830474 | rs10739590 | 0.51 | 0.320507332 | 0.5169 |
| hCV11720413 | rs1930782 | hCV30830638 | rs10985073 | 0.51 | 0.320507332 | 0.9671 |

TABLE 4-continued

| Interrogated SNP | Interrogated rs | LD SNP | LD SNP rs | Power | Threshold r² | r² |
|---|---|---|---|---|---|---|
| hCV11720413 | rs1930782 | hCV30830725 | rs7864019 | 0.51 | 0.320507332 | 0.6687 |
| hCV11720413 | rs1930782 | hCV30830832 | rs10733648 | 0.51 | 0.320507332 | 0.6687 |
| hCV11720413 | rs1930782 | hCV30830909 | rs11794516 | 0.51 | 0.320507332 | 0.9671 |
| hCV11720413 | rs1930782 | hCV7577254 | rs942152 | 0.51 | 0.320507332 | 0.3797 |
| hCV11720413 | rs1930782 | hCV7577317 | rs1323472 | 0.51 | 0.320507332 | 0.6604 |
| hCV11720413 | rs1930782 | hCV7577331 | rs1468673 | 0.51 | 0.320507332 | 0.6604 |
| hCV11720413 | rs1930782 | hCV7577337 | rs993247 | 0.51 | 0.320507332 | 0.3301 |
| hCV11720413 | rs1930782 | hCV7577344 | rs876445 | 0.51 | 0.320507332 | 0.6687 |
| hCV11720413 | rs1930782 | hCV782875 | rs746182 | 0.51 | 0.320507332 | 0.4513 |
| hCV11720414 | rs1930781 | hCV11266229 | rs10435844 | 0.51 | 0.412311868 | 1 |
| hCV11720414 | rs1930781 | hCV11266268 | rs10760121 | 0.51 | 0.412311868 | 0.9666 |
| hCV11720414 | rs1930781 | hCV11720350 | rs2057469 | 0.51 | 0.412311868 | 0.4465 |
| hCV11720414 | rs1930781 | hCV11720413 | rs1930782 | 0.51 | 0.412311868 | 0.6687 |
| hCV11720414 | rs1930781 | hCV15849105 | rs2900185 | 0.51 | 0.412311868 | 0.4708 |
| hCV11720414 | rs1930781 | hCV15849116 | rs2900180 | 0.51 | 0.412311868 | 1 |
| hCV11720414 | rs1930781 | hCV15870898 | rs2072438 | 0.51 | 0.412311868 | 0.6467 |
| hCV11720414 | rs1930781 | hCV16124825 | rs2109895 | 0.51 | 0.412311868 | 1 |
| hCV11720414 | rs1930781 | hCV16175379 | rs2239657 | 0.51 | 0.412311868 | 0.9664 |
| hCV11720414 | rs1930781 | hCV16234795 | rs2416804 | 0.51 | 0.412311868 | 0.6341 |
| hCV11720414 | rs1930781 | hCV16234838 | rs2416819 | 0.51 | 0.412311868 | 0.4465 |
| hCV11720414 | rs1930781 | hCV16234840 | rs2416817 | 0.51 | 0.412311868 | 0.4708 |
| hCV11720414 | rs1930781 | hCV1632195 | rs1998505 | 0.51 | 0.412311868 | 0.4708 |
| hCV11720414 | rs1930781 | hCV1761888 | rs1953126 | 0.51 | 0.412311868 | 0.9666 |
| hCV11720414 | rs1930781 | hCV1761891 | rs1930778 | 0.51 | 0.412311868 | 0.9602 |
| hCV11720414 | rs1930781 | hCV1761894 | rs1609810 | 0.51 | 0.412311868 | 0.9609 |
| hCV11720414 | rs1930781 | hCV2359565 | rs1014530 | 0.51 | 0.412311868 | 0.6687 |
| hCV11720414 | rs1930781 | hCV25613469 | rs10760157 | 0.51 | 0.412311868 | 0.4465 |
| hCV11720414 | rs1930781 | hCV25751916 | rs10985070 | 0.51 | 0.412311868 | 0.6467 |
| hCV11720414 | rs1930781 | hCV25771057 | rs10760150 | 0.51 | 0.412311868 | 0.4708 |
| hCV11720414 | rs1930781 | hCV2783582 | rs10818482 | 0.51 | 0.412311868 | 0.6467 |
| hCV11720414 | rs1930781 | hCV2783586 | rs2270231 | 0.51 | 0.412311868 | 0.9666 |
| hCV11720414 | rs1930781 | hCV2783589 | rs881375 | 0.51 | 0.412311868 | 0.9666 |
| hCV11720414 | rs1930781 | hCV2783590 | rs6478486 | 0.51 | 0.412311868 | 0.9666 |
| hCV11720414 | rs1930781 | hCV2783591 | rs1468671 | 0.51 | 0.412311868 | 1 |
| hCV11720414 | rs1930781 | hCV2783593 | rs1548783 | 0.51 | 0.412311868 | 1 |
| hCV11720414 | rs1930781 | hCV2783597 | rs1860824 | 0.51 | 0.412311868 | 1 |
| hCV11720414 | rs1930781 | hCV2783599 | rs7046108 | 0.51 | 0.412311868 | 1 |
| hCV11720414 | rs1930781 | hCV2783604 | rs10760126 | 0.51 | 0.412311868 | 0.6875 |
| hCV11720414 | rs1930781 | hCV2783607 | rs9886724 | 0.51 | 0.412311868 | 0.6785 |
| hCV11720414 | rs1930781 | hCV2783608 | rs4836834 | 0.51 | 0.412311868 | 0.6687 |
| hCV11720414 | rs1930781 | hCV2783609 | rs2241003 | 0.51 | 0.412311868 | 0.9321 |
| hCV11720414 | rs1930781 | hCV2783611 | rs10435843 | 0.51 | 0.412311868 | 1 |
| hCV11720414 | rs1930781 | hCV2783618 | rs2239658 | 0.51 | 0.412311868 | 1 |
| hCV11720414 | rs1930781 | hCV2783620 | rs7021880 | 0.51 | 0.412311868 | 0.9301 |
| hCV11720414 | rs1930781 | hCV2783621 | rs2416805 | 0.51 | 0.412311868 | 1 |
| hCV11720414 | rs1930781 | hCV2783622 | rs758959 | 0.51 | 0.412311868 | 1 |
| hCV11720414 | rs1930781 | hCV2783625 | rs10118357 | 0.51 | 0.412311868 | 0.6645 |
| hCV11720414 | rs1930781 | hCV2783630 | rs2269060 | 0.51 | 0.412311868 | 0.6687 |
| hCV11720414 | rs1930781 | hCV2783633 | rs7021049 | 0.51 | 0.412311868 | 0.6687 |
| hCV11720414 | rs1930781 | hCV2783634 | rs1014529 | 0.51 | 0.412311868 | 1 |
| hCV11720414 | rs1930781 | hCV2783635 | rs1930780 | 0.51 | 0.412311868 | 1 |
| hCV11720414 | rs1930781 | hCV2783638 | rs3761846 | 0.51 | 0.412311868 | 0.6687 |
| hCV11720414 | rs1930781 | hCV2783640 | rs3761847 | 0.51 | 0.412311868 | 0.6341 |
| hCV11720414 | rs1930781 | hCV2783641 | rs2416806 | 0.51 | 0.412311868 | 1 |
| hCV11720414 | rs1930781 | hCV2783647 | rs10739580 | 0.51 | 0.412311868 | 1 |
| hCV11720414 | rs1930781 | hCV2783650 | rs10760129 | 0.51 | 0.412311868 | 0.6687 |
| hCV11720414 | rs1930781 | hCV2783653 | rs10760130 | 0.51 | 0.412311868 | 0.6687 |
| hCV11720414 | rs1930781 | hCV2783655 | rs10818488 | 0.51 | 0.412311868 | 0.6687 |
| hCV11720414 | rs1930781 | hCV2783656 | rs4837804 | 0.51 | 0.412311868 | 0.8956 |
| hCV11720414 | rs1930781 | hCV2783659 | rs7039505 | 0.51 | 0.412311868 | 1 |
| hCV11720414 | rs1930781 | hCV27912350 | rs4837808 | 0.51 | 0.412311868 | 0.4708 |
| hCV11720414 | rs1930781 | hCV27912351 | rs4837809 | 0.51 | 0.412311868 | 0.4708 |
| hCV11720414 | rs1930781 | hCV29005923 | rs6478494 | 0.51 | 0.412311868 | 0.4238 |
| hCV11720414 | rs1930781 | hCV29005924 | rs7031128 | 0.51 | 0.412311868 | 0.4264 |
| hCV11720414 | rs1930781 | hCV29005976 | rs7037195 | 0.51 | 0.412311868 | 0.6687 |
| hCV11720414 | rs1930781 | hCV29005978 | rs7021206 | 0.51 | 0.412311868 | 1 |
| hCV11720414 | rs1930781 | hCV29006006 | rs7034390 | 0.51 | 0.412311868 | 0.9666 |
| hCV11720414 | rs1930781 | hCV30059070 | rs10156413 | 0.51 | 0.412311868 | 0.5258 |
| hCV11720414 | rs1930781 | hCV3045792 | rs6478499 | 0.51 | 0.412311868 | 0.4879 |
| hCV11720414 | rs1930781 | hCV3045801 | rs2057465 | 0.51 | 0.412311868 | 0.4332 |
| hCV11720414 | rs1930781 | hCV30563729 | rs9299273 | 0.51 | 0.412311868 | 0.4708 |
| hCV11720414 | rs1930781 | hCV30830414 | rs7871371 | 0.51 | 0.412311868 | 0.417 |
| hCV11720414 | rs1930781 | hCV30830468 | rs10818507 | 0.51 | 0.412311868 | 0.4539 |
| hCV11720414 | rs1930781 | hCV30830473 | rs7036649 | 0.51 | 0.412311868 | 0.4705 |
| hCV11720414 | rs1930781 | hCV30830475 | rs10733652 | 0.51 | 0.412311868 | 0.4269 |
| hCV11720414 | rs1930781 | hCV30830484 | rs10818508 | 0.51 | 0.412311868 | 0.4708 |
| hCV11720414 | rs1930781 | hCV30830486 | rs10760149 | 0.51 | 0.412311868 | 0.4708 |

TABLE 4-continued

| Interrogated SNP | Interrogated rs | LD SNP | LD SNP rs | Power | Threshold r² | r² |
|---|---|---|---|---|---|---|
| hCV11720414 | rs1930781 | hCV30830503 | rs4837811 | 0.51 | 0.412311868 | 0.4708 |
| hCV11720414 | rs1930781 | hCV30830512 | rs10818512 | 0.51 | 0.412311868 | 0.4465 |
| hCV11720414 | rs1930781 | hCV30830521 | rs10818513 | 0.51 | 0.412311868 | 0.4465 |
| hCV11720414 | rs1930781 | hCV30830536 | rs7047038 | 0.51 | 0.412311868 | 0.4465 |
| hCV11720414 | rs1930781 | hCV30830638 | rs10985073 | 0.51 | 0.412311868 | 0.6467 |
| hCV11720414 | rs1930781 | hCV30830725 | rs7864019 | 0.51 | 0.412311868 | 1 |
| hCV11720414 | rs1930781 | hCV30830832 | rs10733648 | 0.51 | 0.412311868 | 1 |
| hCV11720414 | rs1930781 | hCV30830909 | rs11794516 | 0.51 | 0.412311868 | 0.6467 |
| hCV11720414 | rs1930781 | hCV7577250 | rs942153 | 0.51 | 0.412311868 | 0.4465 |
| hCV11720414 | rs1930781 | hCV7577271 | rs1535655 | 0.51 | 0.412311868 | 0.4465 |
| hCV11720414 | rs1930781 | hCV7577287 | rs1323478 | 0.51 | 0.412311868 | 0.4708 |
| hCV11720414 | rs1930781 | hCV7577296 | rs1407910 | 0.51 | 0.412311868 | 0.4708 |
| hCV11720414 | rs1930781 | hCV7577344 | rs876445 | 0.51 | 0.412311868 | 1 |
| hCV15849116 | rs2900180 | hCV11266229 | rs10435844 | 0.51 | 0.548091403 | 1 |
| hCV15849116 | rs2900180 | hCV11266268 | rs10760121 | 0.51 | 0.548091403 | 0.9622 |
| hCV15849116 | rs2900180 | hCV11720413 | rs1930782 | 0.51 | 0.548091403 | 0.6587 |
| hCV15849116 | rs2900180 | hCV11720414 | rs1930781 | 0.51 | 0.548091403 | 1 |
| hCV15849116 | rs2900180 | hCV15870898 | rs2072438 | 0.51 | 0.548091403 | 0.6342 |
| hCV15849116 | rs2900180 | hCV16124825 | rs2109895 | 0.51 | 0.548091403 | 1 |
| hCV15849116 | rs2900180 | hCV16175379 | rs2239657 | 0.51 | 0.548091403 | 0.962 |
| hCV15849116 | rs2900180 | hCV16234795 | rs2416804 | 0.51 | 0.548091403 | 0.6181 |
| hCV15849116 | rs2900180 | hCV1761888 | rs1953126 | 0.51 | 0.548091403 | 0.9622 |
| hCV15849116 | rs2900180 | hCV1761891 | rs1930778 | 0.51 | 0.548091403 | 0.9553 |
| hCV15849116 | rs2900180 | hCV1761894 | rs1609810 | 0.51 | 0.548091403 | 0.9559 |
| hCV15849116 | rs2900180 | hCV2359565 | rs1014530 | 0.51 | 0.548091403 | 0.6587 |
| hCV15849116 | rs2900180 | hCV25751916 | rs10985070 | 0.51 | 0.548091403 | 0.6342 |
| hCV15849116 | rs2900180 | hCV2783582 | rs10818482 | 0.51 | 0.548091403 | 0.6342 |
| hCV15849116 | rs2900180 | hCV2783586 | rs2270231 | 0.51 | 0.548091403 | 0.9622 |
| hCV15849116 | rs2900180 | hCV2783589 | rs881375 | 0.51 | 0.548091403 | 0.9622 |
| hCV15849116 | rs2900180 | hCV2783590 | rs6478486 | 0.51 | 0.548091403 | 0.9622 |
| hCV15849116 | rs2900180 | hCV2783591 | rs1468671 | 0.51 | 0.548091403 | 1 |
| hCV15849116 | rs2900180 | hCV2783593 | rs1548783 | 0.51 | 0.548091403 | 1 |
| hCV15849116 | rs2900180 | hCV2783597 | rs1860824 | 0.51 | 0.548091403 | 1 |
| hCV15849116 | rs2900180 | hCV2783599 | rs7046108 | 0.51 | 0.548091403 | 1 |
| hCV15849116 | rs2900180 | hCV2783604 | rs10760126 | 0.51 | 0.548091403 | 0.6795 |
| hCV15849116 | rs2900180 | hCV2783607 | rs9886724 | 0.51 | 0.548091403 | 0.669 |
| hCV15849116 | rs2900180 | hCV2783608 | rs4836834 | 0.51 | 0.548091403 | 0.6587 |
| hCV15849116 | rs2900180 | hCV2783609 | rs2241003 | 0.51 | 0.548091403 | 0.9232 |
| hCV15849116 | rs2900180 | hCV2783611 | rs10435843 | 0.51 | 0.548091403 | 1 |
| hCV15849116 | rs2900180 | hCV2783618 | rs2239658 | 0.51 | 0.548091403 | 1 |
| hCV15849116 | rs2900180 | hCV2783620 | rs7021880 | 0.51 | 0.548091403 | 0.9252 |
| hCV15849116 | rs2900180 | hCV2783621 | rs2416805 | 0.51 | 0.548091403 | 1 |
| hCV15849116 | rs2900180 | hCV2783622 | rs758959 | 0.51 | 0.548091403 | 1 |
| hCV15849116 | rs2900180 | hCV2783625 | rs10118357 | 0.51 | 0.548091403 | 0.6587 |
| hCV15849116 | rs2900180 | hCV2783630 | rs2269060 | 0.51 | 0.548091403 | 0.6587 |
| hCV15849116 | rs2900180 | hCV2783633 | rs7021049 | 0.51 | 0.548091403 | 0.6587 |
| hCV15849116 | rs2900180 | hCV2783634 | rs1014529 | 0.51 | 0.548091403 | 1 |
| hCV15849116 | rs2900180 | hCV2783635 | rs1930780 | 0.51 | 0.548091403 | 1 |
| hCV15849116 | rs2900180 | hCV2783638 | rs3761846 | 0.51 | 0.548091403 | 0.6587 |
| hCV15849116 | rs2900180 | hCV2783640 | rs3761847 | 0.51 | 0.548091403 | 0.6181 |
| hCV15849116 | rs2900180 | hCV2783641 | rs2416806 | 0.51 | 0.548091403 | 1 |
| hCV15849116 | rs2900180 | hCV2783647 | rs10739580 | 0.51 | 0.548091403 | 1 |
| hCV15849116 | rs2900180 | hCV2783650 | rs10760129 | 0.51 | 0.548091403 | 0.6587 |
| hCV15849116 | rs2900180 | hCV2783653 | rs10760130 | 0.51 | 0.548091403 | 0.6587 |
| hCV15849116 | rs2900180 | hCV2783655 | rs10818488 | 0.51 | 0.548091403 | 0.6587 |
| hCV15849116 | rs2900180 | hCV2783656 | rs4837804 | 0.51 | 0.548091403 | 0.8894 |
| hCV15849116 | rs2900180 | hCV2783659 | rs7039505 | 0.51 | 0.548091403 | 1 |
| hCV15849116 | rs2900180 | hCV29005976 | rs7037195 | 0.51 | 0.548091403 | 0.6587 |
| hCV15849116 | rs2900180 | hCV29005978 | rs7021206 | 0.51 | 0.548091403 | 1 |
| hCV15849116 | rs2900180 | hCV29006006 | rs7034390 | 0.51 | 0.548091403 | 0.9622 |
| hCV15849116 | rs2900180 | hCV30830638 | rs10985073 | 0.51 | 0.548091403 | 0.6342 |
| hCV15849116 | rs2900180 | hCV30830725 | rs7864019 | 0.51 | 0.548091403 | 1 |
| hCV15849116 | rs2900180 | hCV30830832 | rs10733648 | 0.51 | 0.548091403 | 1 |
| hCV15849116 | rs2900180 | hCV30830909 | rs11794516 | 0.51 | 0.548091403 | 0.6342 |
| hCV15849116 | rs2900180 | hCV7577344 | rs876445 | 0.51 | 0.548091403 | 1 |
| hCV15870898 | rs2072438 | hCV11266229 | rs10435844 | 0.51 | 0.357983748 | 0.6467 |
| hCV15870898 | rs2072438 | hCV11266268 | rs10760121 | 0.51 | 0.357983748 | 0.6691 |
| hCV15870898 | rs2072438 | hCV11720351 | rs1885995 | 0.51 | 0.357983748 | 0.4963 |
| hCV15870898 | rs2072438 | hCV11720413 | rs1930782 | 0.51 | 0.357983748 | 0.9671 |
| hCV15870898 | rs2072438 | hCV11720414 | rs1930781 | 0.51 | 0.357983748 | 0.6467 |
| hCV15870898 | rs2072438 | hCV1452630 | rs10818476 | 0.51 | 0.357983748 | 0.3756 |
| hCV15870898 | rs2072438 | hCV1452665 | rs4837796 | 0.51 | 0.357983748 | 0.3756 |
| hCV15870898 | rs2072438 | hCV15751717 | rs2296077 | 0.51 | 0.357983748 | 0.4374 |
| hCV15870898 | rs2072438 | hCV15751719 | rs2146838 | 0.51 | 0.357983748 | 0.4963 |
| hCV15870898 | rs2072438 | hCV15757738 | rs2302498 | 0.51 | 0.357983748 | 0.4505 |
| hCV15870898 | rs2072438 | hCV15849116 | rs2900180 | 0.51 | 0.357983748 | 0.6342 |
| hCV15870898 | rs2072438 | hCV16124825 | rs2109895 | 0.51 | 0.357983748 | 0.6467 |

TABLE 4-continued

| Interrogated SNP | Interrogated rs | LD SNP | LD SNP rs | Power | Threshold r² | r² |
|---|---|---|---|---|---|---|
| hCV15870898 | rs2072438 | hCV16175379 | rs2239657 | 0.51 | 0.357983748 | 0.625 |
| hCV15870898 | rs2072438 | hCV16234795 | rs2416804 | 0.51 | 0.357983748 | 0.9353 |
| hCV15870898 | rs2072438 | hCV1761888 | rs1953126 | 0.51 | 0.357983748 | 0.6691 |
| hCV15870898 | rs2072438 | hCV1761891 | rs1930778 | 0.51 | 0.357983748 | 0.6222 |
| hCV15870898 | rs2072438 | hCV1761894 | rs1609810 | 0.51 | 0.357983748 | 0.6485 |
| hCV15870898 | rs2072438 | hCV22272588 | rs10760117 | 0.51 | 0.357983748 | 0.3756 |
| hCV15870898 | rs2072438 | hCV2359565 | rs1014530 | 0.51 | 0.357983748 | 0.9671 |
| hCV15870898 | rs2072438 | hCV25751916 | rs10985070 | 0.51 | 0.357983748 | 1 |
| hCV15870898 | rs2072438 | hCV26144307 | rs1016468 | 0.51 | 0.357983748 | 0.4963 |
| hCV15870898 | rs2072438 | hCV26144332 | rs4837813 | 0.51 | 0.357983748 | 0.4761 |
| hCV15870898 | rs2072438 | hCV2783582 | rs10818482 | 0.51 | 0.357983748 | 1 |
| hCV15870898 | rs2072438 | hCV2783586 | rs2270231 | 0.51 | 0.357983748 | 0.6691 |
| hCV15870898 | rs2072438 | hCV2783589 | rs881375 | 0.51 | 0.357983748 | 0.6691 |
| hCV15870898 | rs2072438 | hCV2783590 | rs6478486 | 0.51 | 0.357983748 | 0.6691 |
| hCV15870898 | rs2072438 | hCV2783591 | rs1468671 | 0.51 | 0.357983748 | 0.6467 |
| hCV15870898 | rs2072438 | hCV2783593 | rs1548783 | 0.51 | 0.357983748 | 0.6423 |
| hCV15870898 | rs2072438 | hCV2783597 | rs1860824 | 0.51 | 0.357983748 | 0.6357 |
| hCV15870898 | rs2072438 | hCV2783599 | rs7046108 | 0.51 | 0.357983748 | 0.6467 |
| hCV15870898 | rs2072438 | hCV2783604 | rs10760126 | 0.51 | 0.357983748 | 0.9666 |
| hCV15870898 | rs2072438 | hCV2783607 | rs9886724 | 0.51 | 0.357983748 | 1 |
| hCV15870898 | rs2072438 | hCV2783608 | rs4836834 | 0.51 | 0.357983748 | 0.9671 |
| hCV15870898 | rs2072438 | hCV2783609 | rs2241003 | 0.51 | 0.357983748 | 0.7074 |
| hCV15870898 | rs2072438 | hCV2783611 | rs10435843 | 0.51 | 0.357983748 | 0.6467 |
| hCV15870898 | rs2072438 | hCV2783618 | rs2239658 | 0.51 | 0.357983748 | 0.6467 |
| hCV15870898 | rs2072438 | hCV2783620 | rs7021880 | 0.51 | 0.357983748 | 0.5878 |
| hCV15870898 | rs2072438 | hCV2783621 | rs2416805 | 0.51 | 0.357983748 | 0.6467 |
| hCV15870898 | rs2072438 | hCV2783622 | rs758959 | 0.51 | 0.357983748 | 0.6467 |
| hCV15870898 | rs2072438 | hCV2783625 | rs10118357 | 0.51 | 0.357983748 | 0.9665 |
| hCV15870898 | rs2072438 | hCV2783630 | rs2269060 | 0.51 | 0.357983748 | 0.9671 |
| hCV15870898 | rs2072438 | hCV2783633 | rs7021049 | 0.51 | 0.357983748 | 0.9671 |
| hCV15870898 | rs2072438 | hCV2783634 | rs1014529 | 0.51 | 0.357983748 | 0.6467 |
| hCV15870898 | rs2072438 | hCV2783635 | rs1930780 | 0.51 | 0.357983748 | 0.6467 |
| hCV15870898 | rs2072438 | hCV2783638 | rs3761846 | 0.51 | 0.357983748 | 0.9671 |
| hCV15870898 | rs2072438 | hCV2783640 | rs3761847 | 0.51 | 0.357983748 | 0.9353 |
| hCV15870898 | rs2072438 | hCV2783641 | rs2416806 | 0.51 | 0.357983748 | 0.6594 |
| hCV15870898 | rs2072438 | hCV2783647 | rs10739580 | 0.51 | 0.357983748 | 0.6467 |
| hCV15870898 | rs2072438 | hCV2783650 | rs10760129 | 0.51 | 0.357983748 | 0.9671 |
| hCV15870898 | rs2072438 | hCV2783653 | rs10760130 | 0.51 | 0.357983748 | 0.9671 |
| hCV15870898 | rs2072438 | hCV2783655 | rs10818488 | 0.51 | 0.357983748 | 0.9671 |
| hCV15870898 | rs2072438 | hCV2783656 | rs4837804 | 0.51 | 0.357983748 | 0.7472 |
| hCV15870898 | rs2072438 | hCV2783659 | rs7039505 | 0.51 | 0.357983748 | 0.6319 |
| hCV15870898 | rs2072438 | hCV2783711 | rs10733650 | 0.51 | 0.357983748 | 0.3903 |
| hCV15870898 | rs2072438 | hCV2783718 | rs10818500 | 0.51 | 0.357983748 | 0.6972 |
| hCV15870898 | rs2072438 | hCV29005955 | rs7036980 | 0.51 | 0.357983748 | 0.4304 |
| hCV15870898 | rs2072438 | hCV29005976 | rs7037195 | 0.51 | 0.357983748 | 0.9671 |
| hCV15870898 | rs2072438 | hCV29005978 | rs7021206 | 0.51 | 0.357983748 | 0.6788 |
| hCV15870898 | rs2072438 | hCV29006006 | rs7034390 | 0.51 | 0.357983748 | 0.6691 |
| hCV15870898 | rs2072438 | hCV29879049 | rs9792437 | 0.51 | 0.357983748 | 0.4711 |
| hCV15870898 | rs2072438 | hCV3045812 | rs7030849 | 0.51 | 0.357983748 | 0.4711 |
| hCV15870898 | rs2072438 | hCV30830319 | rs7037673 | 0.51 | 0.357983748 | 0.5359 |
| hCV15870898 | rs2072438 | hCV30830325 | rs10818494 | 0.51 | 0.357983748 | 0.4346 |
| hCV15870898 | rs2072438 | hCV30830340 | rs10760134 | 0.51 | 0.357983748 | 0.4135 |
| hCV15870898 | rs2072438 | hCV30830341 | rs7040033 | 0.51 | 0.357983748 | 0.4135 |
| hCV15870898 | rs2072438 | hCV30830419 | rs10985140 | 0.51 | 0.357983748 | 0.6598 |
| hCV15870898 | rs2072438 | hCV30830474 | rs10739590 | 0.51 | 0.357983748 | 0.5521 |
| hCV15870898 | rs2072438 | hCV30830638 | rs10985073 | 0.51 | 0.357983748 | 1 |
| hCV15870898 | rs2072438 | hCV30830725 | rs7864019 | 0.51 | 0.357983748 | 0.6467 |
| hCV15870898 | rs2072438 | hCV30830832 | rs10733648 | 0.51 | 0.357983748 | 0.6467 |
| hCV15870898 | rs2072438 | hCV30830909 | rs11794516 | 0.51 | 0.357983748 | 1 |
| hCV15870898 | rs2072438 | hCV7577254 | rs942152 | 0.51 | 0.357983748 | 0.4017 |
| hCV15870898 | rs2072438 | hCV7577317 | rs1323472 | 0.51 | 0.357983748 | 0.6896 |
| hCV15870898 | rs2072438 | hCV7577331 | rs1468673 | 0.51 | 0.357983748 | 0.6896 |
| hCV15870898 | rs2072438 | hCV7577344 | rs876445 | 0.51 | 0.357983748 | 0.6467 |
| hCV15870898 | rs2072438 | hCV782875 | rs746182 | 0.51 | 0.357983748 | 0.4761 |
| hCV16175379 | rs2239657 | hCV11266229 | rs10435844 | 0.51 | 0.423423973 | 0.9664 |
| hCV16175379 | rs2239657 | hCV11266268 | rs10760121 | 0.51 | 0.423423973 | 0.9341 |
| hCV16175379 | rs2239657 | hCV11720413 | rs1930782 | 0.51 | 0.423423973 | 0.6463 |
| hCV16175379 | rs2239657 | hCV11720414 | rs1930781 | 0.51 | 0.423423973 | 0.9664 |
| hCV16175379 | rs2239657 | hCV15849105 | rs2900185 | 0.51 | 0.423423973 | 0.4418 |
| hCV16175379 | rs2239657 | hCV15849116 | rs2900180 | 0.51 | 0.423423973 | 0.962 |
| hCV16175379 | rs2239657 | hCV15870898 | rs2072438 | 0.51 | 0.423423973 | 0.625 |
| hCV16175379 | rs2239657 | hCV16124825 | rs2109895 | 0.51 | 0.423423973 | 0.9664 |
| hCV16175379 | rs2239657 | hCV16234795 | rs2416804 | 0.51 | 0.423423973 | 0.6112 |
| hCV16175379 | rs2239657 | hCV16234840 | rs2416817 | 0.51 | 0.423423973 | 0.4418 |
| hCV16175379 | rs2239657 | hCV1632195 | rs1998505 | 0.51 | 0.423423973 | 0.4418 |
| hCV16175379 | rs2239657 | hCV1761888 | rs1953126 | 0.51 | 0.423423973 | 0.9341 |
| hCV16175379 | rs2239657 | hCV1761891 | rs1930778 | 0.51 | 0.423423973 | 0.9602 |

TABLE 4-continued

| Interrogated SNP | Interrogated rs | LD SNP | LD SNP rs | Power | Threshold r² | r² |
|---|---|---|---|---|---|---|
| hCV16175379 | rs2239657 | hCV1761894 | rs1609810 | 0.51 | 0.423423973 | 0.9609 |
| hCV16175379 | rs2239657 | hCV2359565 | rs1014530 | 0.51 | 0.423423973 | 0.6463 |
| hCV16175379 | rs2239657 | hCV25751916 | rs10985070 | 0.51 | 0.423423973 | 0.625 |
| hCV16175379 | rs2239657 | hCV25771057 | rs10760150 | 0.51 | 0.423423973 | 0.4418 |
| hCV16175379 | rs2239657 | hCV2783582 | rs10818482 | 0.51 | 0.423423973 | 0.625 |
| hCV16175379 | rs2239657 | hCV2783586 | rs2270231 | 0.51 | 0.423423973 | 0.9341 |
| hCV16175379 | rs2239657 | hCV2783589 | rs881375 | 0.51 | 0.423423973 | 0.9341 |
| hCV16175379 | rs2239657 | hCV2783590 | rs6478486 | 0.51 | 0.423423973 | 0.9341 |
| hCV16175379 | rs2239657 | hCV2783591 | rs1468671 | 0.51 | 0.423423973 | 0.9664 |
| hCV16175379 | rs2239657 | hCV2783593 | rs1548783 | 0.51 | 0.423423973 | 0.966 |
| hCV16175379 | rs2239657 | hCV2783597 | rs1860824 | 0.51 | 0.423423973 | 0.9647 |
| hCV16175379 | rs2239657 | hCV2783599 | rs7046108 | 0.51 | 0.423423973 | 0.9664 |
| hCV16175379 | rs2239657 | hCV2783604 | rs10760126 | 0.51 | 0.423423973 | 0.6641 |
| hCV16175379 | rs2239657 | hCV2783607 | rs9886724 | 0.51 | 0.423423973 | 0.6545 |
| hCV16175379 | rs2239657 | hCV2783608 | rs4836834 | 0.51 | 0.423423973 | 0.6463 |
| hCV16175379 | rs2239657 | hCV2783609 | rs2241003 | 0.51 | 0.423423973 | 0.8997 |
| hCV16175379 | rs2239657 | hCV2783611 | rs10435843 | 0.51 | 0.423423973 | 0.9664 |
| hCV16175379 | rs2239657 | hCV2783618 | rs2239658 | 0.51 | 0.423423973 | 0.9664 |
| hCV16175379 | rs2239657 | hCV2783620 | rs7021880 | 0.51 | 0.423423973 | 0.8938 |
| hCV16175379 | rs2239657 | hCV2783621 | rs2416805 | 0.51 | 0.423423973 | 0.9664 |
| hCV16175379 | rs2239657 | hCV2783622 | rs758959 | 0.51 | 0.423423973 | 0.9664 |
| hCV16175379 | rs2239657 | hCV2783625 | rs10118357 | 0.51 | 0.423423973 | 0.6419 |
| hCV16175379 | rs2239657 | hCV2783630 | rs2269060 | 0.51 | 0.423423973 | 0.6463 |
| hCV16175379 | rs2239657 | hCV2783633 | rs7021049 | 0.51 | 0.423423973 | 0.6463 |
| hCV16175379 | rs2239657 | hCV2783634 | rs1014529 | 0.51 | 0.423423973 | 0.9664 |
| hCV16175379 | rs2239657 | hCV2783635 | rs1930780 | 0.51 | 0.423423973 | 0.9664 |
| hCV16175379 | rs2239657 | hCV2783638 | rs3761846 | 0.51 | 0.423423973 | 0.6463 |
| hCV16175379 | rs2239657 | hCV2783640 | rs3761847 | 0.51 | 0.423423973 | 0.6112 |
| hCV16175379 | rs2239657 | hCV2783641 | rs2416806 | 0.51 | 0.423423973 | 0.9652 |
| hCV16175379 | rs2239657 | hCV2783647 | rs10739580 | 0.51 | 0.423423973 | 0.9664 |
| hCV16175379 | rs2239657 | hCV2783650 | rs10760129 | 0.51 | 0.423423973 | 0.6463 |
| hCV16175379 | rs2239657 | hCV2783653 | rs10760130 | 0.51 | 0.423423973 | 0.6463 |
| hCV16175379 | rs2239657 | hCV2783655 | rs10818488 | 0.51 | 0.423423973 | 0.6463 |
| hCV16175379 | rs2239657 | hCV2783656 | rs4837804 | 0.51 | 0.423423973 | 0.8631 |
| hCV16175379 | rs2239657 | hCV2783659 | rs7039505 | 0.51 | 0.423423973 | 1 |
| hCV16175379 | rs2239657 | hCV27912350 | rs4837808 | 0.51 | 0.423423973 | 0.4418 |
| hCV16175379 | rs2239657 | hCV27912351 | rs4837809 | 0.51 | 0.423423973 | 0.4418 |
| hCV16175379 | rs2239657 | hCV29005976 | rs7037195 | 0.51 | 0.423423973 | 0.6463 |
| hCV16175379 | rs2239657 | hCV29005978 | rs7021206 | 0.51 | 0.423423973 | 0.9649 |
| hCV16175379 | rs2239657 | hCV29006006 | rs7034390 | 0.51 | 0.423423973 | 0.9341 |
| hCV16175379 | rs2239657 | hCV30059070 | rs10156413 | 0.51 | 0.423423973 | 0.4892 |
| hCV16175379 | rs2239657 | hCV3045792 | rs6478499 | 0.51 | 0.423423973 | 0.4586 |
| hCV16175379 | rs2239657 | hCV30563729 | rs9299273 | 0.51 | 0.423423973 | 0.4418 |
| hCV16175379 | rs2239657 | hCV30830468 | rs10818507 | 0.51 | 0.423423973 | 0.4248 |
| hCV16175379 | rs2239657 | hCV30830473 | rs7036649 | 0.51 | 0.423423973 | 0.4387 |
| hCV16175379 | rs2239657 | hCV30830484 | rs10818508 | 0.51 | 0.423423973 | 0.4418 |
| hCV16175379 | rs2239657 | hCV30830486 | rs10760149 | 0.51 | 0.423423973 | 0.4418 |
| hCV16175379 | rs2239657 | hCV30830503 | rs4837811 | 0.51 | 0.423423973 | 0.4418 |
| hCV16175379 | rs2239657 | hCV30830638 | rs10985073 | 0.51 | 0.423423973 | 0.625 |
| hCV16175379 | rs2239657 | hCV30830725 | rs7864019 | 0.51 | 0.423423973 | 0.9664 |
| hCV16175379 | rs2239657 | hCV30830832 | rs10733648 | 0.51 | 0.423423973 | 0.9664 |
| hCV16175379 | rs2239657 | hCV30830909 | rs11794516 | 0.51 | 0.423423973 | 0.625 |
| hCV16175379 | rs2239657 | hCV7577287 | rs1323478 | 0.51 | 0.423423973 | 0.4418 |
| hCV16175379 | rs2239657 | hCV7577296 | rs1407910 | 0.51 | 0.423423973 | 0.4418 |
| hCV16175379 | rs2239657 | hCV7577344 | rs876445 | 0.51 | 0.423423973 | 0.9664 |
| hCV16234785 | rs2416811 | hCV11720383 | rs1051784 | 0.51 | 0.852868152 | 0.9293 |
| hCV16234785 | rs2416811 | hCV11720402 | rs17611 | 0.51 | 0.852868152 | 1 |
| hCV16234785 | rs2416811 | hCV15751718 | rs2296078 | 0.51 | 0.852868152 | 0.8957 |
| hCV16234785 | rs2416811 | hCV15755658 | rs2300934 | 0.51 | 0.852868152 | 0.9646 |
| hCV16234785 | rs2416811 | hCV1632190 | rs10760146 | 0.51 | 0.852868152 | 0.9293 |
| hCV16234785 | rs2416811 | hCV2359571 | rs25681 | 0.51 | 0.852868152 | 1 |
| hCV16234785 | rs2416811 | hCV25968825 | rs10818504 | 0.51 | 0.852868152 | 0.9293 |
| hCV16234785 | rs2416811 | hCV26144282 | rs10818499 | 0.51 | 0.852868152 | 1 |
| hCV16234785 | rs2416811 | hCV26144291 | rs4570235 | 0.51 | 0.852868152 | 1 |
| hCV16234785 | rs2416811 | hCV26144296 | rs10760143 | 0.51 | 0.852868152 | 0.9279 |
| hCV16234785 | rs2416811 | hCV27476319 | rs3747843 | 0.51 | 0.852868152 | 0.8957 |
| hCV16234785 | rs2416811 | hCV2783711 | rs10733650 | 0.51 | 0.852868152 | 1 |
| hCV16234785 | rs2416811 | hCV29005933 | rs7042135 | 0.51 | 0.852868152 | 0.9646 |
| hCV16234785 | rs2416811 | hCV29005936 | rs6478498 | 0.51 | 0.852868152 | 0.9646 |
| hCV16234785 | rs2416811 | hCV29734592 | rs10435889 | 0.51 | 0.852868152 | 1 |
| hCV16234785 | rs2416811 | hCV29824827 | rs9657673 | 0.51 | 0.852868152 | 0.9251 |
| hCV16234785 | rs2416811 | hCV30041036 | rs10156476 | 0.51 | 0.852868152 | 0.9286 |
| hCV16234785 | rs2416811 | hCV30167357 | rs7022941 | 0.51 | 0.852868152 | 0.9642 |
| hCV16234785 | rs2416811 | hCV3045797 | rs7036541 | 0.51 | 0.852868152 | 0.9272 |
| hCV16234785 | rs2416811 | hCV3045800 | rs3736855 | 0.51 | 0.852868152 | 0.9293 |
| hCV16234785 | rs2416811 | hCV3045808 | rs10818516 | 0.51 | 0.852868152 | 0.8595 |
| hCV16234785 | rs2416811 | hCV3045810 | rs2209076 | 0.51 | 0.852868152 | 0.8635 |

TABLE 4-continued

| Interrogated SNP | Interrogated rs | LD SNP | LD SNP rs | Power | Threshold r² | r² |
|---|---|---|---|---|---|---|
| hCV16234785 | rs2416811 | hCV30830340 | rs10760134 | 0.51 | 0.852868152 | 0.8956 |
| hCV16234785 | rs2416811 | hCV30830341 | rs7040033 | 0.51 | 0.852868152 | 0.8956 |
| hCV16234785 | rs2416811 | hCV30830415 | rs7855998 | 0.51 | 0.852868152 | 0.9646 |
| hCV16234785 | rs2416811 | hCV30830427 | rs10760142 | 0.51 | 0.852868152 | 0.9646 |
| hCV16234785 | rs2416811 | hCV30830440 | rs10760144 | 0.51 | 0.852868152 | 0.9293 |
| hCV16234785 | rs2416811 | hCV30830506 | rs10760151 | 0.51 | 0.852868152 | 0.9293 |
| hCV16234785 | rs2416811 | hCV30830537 | rs10818515 | 0.51 | 0.852868152 | 0.8946 |
| hCV16234785 | rs2416811 | hCV30830539 | rs10760153 | 0.51 | 0.852868152 | 0.9287 |
| hCV16234785 | rs2416811 | hCV30830540 | rs10760154 | 0.51 | 0.852868152 | 0.8956 |
| hCV16234785 | rs2416811 | hCV30830541 | rs10760155 | 0.51 | 0.852868152 | 0.8957 |
| hCV16234785 | rs2416811 | hCV30830542 | rs10760156 | 0.51 | 0.852868152 | 0.8894 |
| hCV16234785 | rs2416811 | hCV7577235 | rs1052508 | 0.51 | 0.852868152 | 0.8957 |
| hCV16234785 | rs2416811 | hCV7577248 | rs1359086 | 0.51 | 0.852868152 | 0.8635 |
| hCV16234785 | rs2416811 | hCV7577249 | rs1359085 | 0.51 | 0.852868152 | 0.8957 |
| hCV16234785 | rs2416811 | hCV7577337 | rs993247 | 0.51 | 0.852868152 | 1 |
| hCV16234795 | rs2416804 | hCV11266229 | rs10435844 | 0.51 | 0.321177244 | 0.6341 |
| hCV16234795 | rs2416804 | hCV11266268 | rs10760121 | 0.51 | 0.321177244 | 0.6014 |
| hCV16234795 | rs2416804 | hCV11720351 | rs1885995 | 0.51 | 0.321177244 | 0.4991 |
| hCV16234795 | rs2416804 | hCV11720402 | rs17611 | 0.51 | 0.321177244 | 0.3592 |
| hCV16234795 | rs2416804 | hCV11720413 | rs1930782 | 0.51 | 0.321177244 | 0.9672 |
| hCV16234795 | rs2416804 | hCV11720414 | rs1930781 | 0.51 | 0.321177244 | 0.6341 |
| hCV16234795 | rs2416804 | hCV1452630 | rs10818476 | 0.51 | 0.321177244 | 0.3275 |
| hCV16234795 | rs2416804 | hCV1452665 | rs4837796 | 0.51 | 0.321177244 | 0.3275 |
| hCV16234795 | rs2416804 | hCV15751717 | rs2296077 | 0.51 | 0.321177244 | 0.4385 |
| hCV16234795 | rs2416804 | hCV15751719 | rs2146838 | 0.51 | 0.321177244 | 0.4991 |
| hCV16234795 | rs2416804 | hCV15755658 | rs2300934 | 0.51 | 0.321177244 | 0.3423 |
| hCV16234795 | rs2416804 | hCV15757738 | rs2302498 | 0.51 | 0.321177244 | 0.4513 |
| hCV16234795 | rs2416804 | hCV15849116 | rs2900180 | 0.51 | 0.321177244 | 0.6181 |
| hCV16234795 | rs2416804 | hCV15870898 | rs2072438 | 0.51 | 0.321177244 | 0.9353 |
| hCV16234795 | rs2416804 | hCV16124825 | rs2109895 | 0.51 | 0.321177244 | 0.6341 |
| hCV16234795 | rs2416804 | hCV16175379 | rs2239657 | 0.51 | 0.321177244 | 0.6112 |
| hCV16234795 | rs2416804 | hCV16234785 | rs2416811 | 0.51 | 0.321177244 | 0.3592 |
| hCV16234795 | rs2416804 | hCV1761881 | rs3933326 | 0.51 | 0.321177244 | 0.3407 |
| hCV16234795 | rs2416804 | hCV1761888 | rs1953126 | 0.51 | 0.321177244 | 0.6014 |
| hCV16234795 | rs2416804 | hCV1761891 | rs1930778 | 0.51 | 0.321177244 | 0.5354 |
| hCV16234795 | rs2416804 | hCV1761894 | rs1609810 | 0.51 | 0.321177244 | 0.6068 |
| hCV16234795 | rs2416804 | hCV22272588 | rs10760117 | 0.51 | 0.321177244 | 0.3275 |
| hCV16234795 | rs2416804 | hCV2359565 | rs1014530 | 0.51 | 0.321177244 | 0.9672 |
| hCV16234795 | rs2416804 | hCV2359571 | rs25681 | 0.51 | 0.321177244 | 0.3592 |
| hCV16234795 | rs2416804 | hCV25751916 | rs10985070 | 0.51 | 0.321177244 | 0.9353 |
| hCV16234795 | rs2416804 | hCV25757804 | rs4836833 | 0.51 | 0.321177244 | 0.3234 |
| hCV16234795 | rs2416804 | hCV26144282 | rs10818499 | 0.51 | 0.321177244 | 0.3592 |
| hCV16234795 | rs2416804 | hCV26144291 | rs4570235 | 0.51 | 0.321177244 | 0.3592 |
| hCV16234795 | rs2416804 | hCV26144307 | rs1016468 | 0.51 | 0.321177244 | 0.4991 |
| hCV16234795 | rs2416804 | hCV26144332 | rs4837813 | 0.51 | 0.321177244 | 0.476 |
| hCV16234795 | rs2416804 | hCV2783582 | rs10818482 | 0.51 | 0.321177244 | 0.9353 |
| hCV16234795 | rs2416804 | hCV2783586 | rs2270231 | 0.51 | 0.321177244 | 0.6014 |
| hCV16234795 | rs2416804 | hCV2783589 | rs881375 | 0.51 | 0.321177244 | 0.6014 |
| hCV16234795 | rs2416804 | hCV2783590 | rs6478486 | 0.51 | 0.321177244 | 0.6014 |
| hCV16234795 | rs2416804 | hCV2783591 | rs1468671 | 0.51 | 0.321177244 | 0.6341 |
| hCV16234795 | rs2416804 | hCV2783593 | rs1548783 | 0.51 | 0.321177244 | 0.6289 |
| hCV16234795 | rs2416804 | hCV2783597 | rs1860824 | 0.51 | 0.321177244 | 0.6215 |
| hCV16234795 | rs2416804 | hCV2783599 | rs7046108 | 0.51 | 0.321177244 | 0.6341 |
| hCV16234795 | rs2416804 | hCV2783604 | rs10760126 | 0.51 | 0.321177244 | 0.9666 |
| hCV16234795 | rs2416804 | hCV2783607 | rs9886724 | 0.51 | 0.321177244 | 0.9655 |
| hCV16234795 | rs2416804 | hCV2783608 | rs4836834 | 0.51 | 0.321177244 | 0.9672 |
| hCV16234795 | rs2416804 | hCV2783609 | rs2241003 | 0.51 | 0.321177244 | 0.6714 |
| hCV16234795 | rs2416804 | hCV2783611 | rs10435843 | 0.51 | 0.321177244 | 0.6341 |
| hCV16234795 | rs2416804 | hCV2783618 | rs2239658 | 0.51 | 0.321177244 | 0.6341 |
| hCV16234795 | rs2416804 | hCV2783620 | rs7021880 | 0.51 | 0.321177244 | 0.5724 |
| hCV16234795 | rs2416804 | hCV2783621 | rs2416805 | 0.51 | 0.321177244 | 0.6341 |
| hCV16234795 | rs2416804 | hCV2783622 | rs758959 | 0.51 | 0.321177244 | 0.6341 |
| hCV16234795 | rs2416804 | hCV2783625 | rs10118357 | 0.51 | 0.321177244 | 0.9666 |
| hCV16234795 | rs2416804 | hCV2783630 | rs2269060 | 0.51 | 0.321177244 | 0.9672 |
| hCV16234795 | rs2416804 | hCV2783633 | rs7021049 | 0.51 | 0.321177244 | 0.9672 |
| hCV16234795 | rs2416804 | hCV2783634 | rs1014529 | 0.51 | 0.321177244 | 0.6341 |
| hCV16234795 | rs2416804 | hCV2783635 | rs1930780 | 0.51 | 0.321177244 | 0.6341 |
| hCV16234795 | rs2416804 | hCV2783638 | rs3761846 | 0.51 | 0.321177244 | 0.9672 |
| hCV16234795 | rs2416804 | hCV2783640 | rs3761847 | 0.51 | 0.321177244 | 0.9341 |
| hCV16234795 | rs2416804 | hCV2783641 | rs2416806 | 0.51 | 0.321177244 | 0.6235 |
| hCV16234795 | rs2416804 | hCV2783647 | rs10739580 | 0.51 | 0.321177244 | 0.6341 |
| hCV16234795 | rs2416804 | hCV2783650 | rs10760129 | 0.51 | 0.321177244 | 0.9672 |
| hCV16234795 | rs2416804 | hCV2783653 | rs10760130 | 0.51 | 0.321177244 | 0.9672 |
| hCV16234795 | rs2416804 | hCV2783655 | rs10818488 | 0.51 | 0.321177244 | 0.9672 |
| hCV16234795 | rs2416804 | hCV2783656 | rs4837804 | 0.51 | 0.321177244 | 0.7379 |
| hCV16234795 | rs2416804 | hCV2783659 | rs7039505 | 0.51 | 0.321177244 | 0.6146 |
| hCV16234795 | rs2416804 | hCV2783711 | rs10733650 | 0.51 | 0.321177244 | 0.3571 |

TABLE 4-continued

| Interrogated SNP | Interrogated rs | LD SNP | LD SNP rs | Power | Threshold r² | r² |
|---|---|---|---|---|---|---|
| hCV16234795 | rs2416804 | hCV2783718 | rs10818500 | 0.51 | 0.321177244 | 0.6979 |
| hCV16234795 | rs2416804 | hCV29005933 | rs7042135 | 0.51 | 0.321177244 | 0.3423 |
| hCV16234795 | rs2416804 | hCV29005936 | rs6478498 | 0.51 | 0.321177244 | 0.3423 |
| hCV16234795 | rs2416804 | hCV29005955 | rs7036980 | 0.51 | 0.321177244 | 0.4285 |
| hCV16234795 | rs2416804 | hCV29005976 | rs7037195 | 0.51 | 0.321177244 | 0.9672 |
| hCV16234795 | rs2416804 | hCV29005978 | rs7021206 | 0.51 | 0.321177244 | 0.6666 |
| hCV16234795 | rs2416804 | hCV29006006 | rs7034390 | 0.51 | 0.321177244 | 0.6014 |
| hCV16234795 | rs2416804 | hCV29734592 | rs10435889 | 0.51 | 0.321177244 | 0.3475 |
| hCV16234795 | rs2416804 | hCV29879049 | rs9792437 | 0.51 | 0.321177244 | 0.4729 |
| hCV16234795 | rs2416804 | hCV30167357 | rs7022941 | 0.51 | 0.321177244 | 0.3336 |
| hCV16234795 | rs2416804 | hCV3045812 | rs7030849 | 0.51 | 0.321177244 | 0.4729 |
| hCV16234795 | rs2416804 | hCV30830319 | rs7037673 | 0.51 | 0.321177244 | 0.4992 |
| hCV16234795 | rs2416804 | hCV30830325 | rs10818494 | 0.51 | 0.321177244 | 0.4528 |
| hCV16234795 | rs2416804 | hCV30830340 | rs10760134 | 0.51 | 0.321177244 | 0.4257 |
| hCV16234795 | rs2416804 | hCV30830341 | rs7040033 | 0.51 | 0.321177244 | 0.4257 |
| hCV16234795 | rs2416804 | hCV30830415 | rs7855998 | 0.51 | 0.321177244 | 0.3423 |
| hCV16234795 | rs2416804 | hCV30830419 | rs10985140 | 0.51 | 0.321177244 | 0.6604 |
| hCV16234795 | rs2416804 | hCV30830427 | rs10760142 | 0.51 | 0.321177244 | 0.3423 |
| hCV16234795 | rs2416804 | hCV30830474 | rs10739590 | 0.51 | 0.321177244 | 0.5503 |
| hCV16234795 | rs2416804 | hCV30830638 | rs10985073 | 0.51 | 0.321177244 | 0.9353 |
| hCV16234795 | rs2416804 | hCV30830725 | rs7864019 | 0.51 | 0.321177244 | 0.6341 |
| hCV16234795 | rs2416804 | hCV30830832 | rs10733648 | 0.51 | 0.321177244 | 0.6341 |
| hCV16234795 | rs2416804 | hCV30830909 | rs11794516 | 0.51 | 0.321177244 | 0.9353 |
| hCV16234795 | rs2416804 | hCV7577254 | rs942152 | 0.51 | 0.321177244 | 0.4043 |
| hCV16234795 | rs2416804 | hCV7577317 | rs1323472 | 0.51 | 0.321177244 | 0.6889 |
| hCV16234795 | rs2416804 | hCV7577331 | rs1468673 | 0.51 | 0.321177244 | 0.6889 |
| hCV16234795 | rs2416804 | hCV7577337 | rs993247 | 0.51 | 0.321177244 | 0.3592 |
| hCV16234795 | rs2416804 | hCV7577344 | rs876445 | 0.51 | 0.321177244 | 0.6341 |
| hCV16234795 | rs2416804 | hCV782875 | rs746182 | 0.51 | 0.321177244 | 0.476 |
| hCV16234795 | rs2416804 | hCV8780517 | rs1056567 | 0.51 | 0.321177244 | 0.3234 |
| hCV1632190 | rs10760146 | hCV11720383 | rs1951784 | 0.51 | 0.849855381 | 0.9293 |
| hCV1632190 | rs10760146 | hCV11720402 | rs17611 | 0.51 | 0.849855381 | 0.9293 |
| hCV1632190 | rs10760146 | hCV15751718 | rs2296078 | 0.51 | 0.849855381 | 0.9649 |
| hCV1632190 | rs10760146 | hCV15755658 | rs2300934 | 0.51 | 0.849855381 | 0.8947 |
| hCV1632190 | rs10760146 | hCV16234785 | rs2416811 | 0.51 | 0.849855381 | 0.9293 |
| hCV1632190 | rs10760146 | hCV2359571 | rs25681 | 0.51 | 0.849855381 | 0.9293 |
| hCV1632190 | rs10760146 | hCV25968825 | rs10818504 | 0.51 | 0.849855381 | 1 |
| hCV1632190 | rs10760146 | hCV26144282 | rs10818499 | 0.51 | 0.849855381 | 0.9293 |
| hCV1632190 | rs10760146 | hCV26144291 | rs4570235 | 0.51 | 0.849855381 | 0.9293 |
| hCV1632190 | rs10760146 | hCV26144296 | rs10760143 | 0.51 | 0.849855381 | 1 |
| hCV1632190 | rs10760146 | hCV27476319 | rs3747843 | 0.51 | 0.849855381 | 0.9649 |
| hCV1632190 | rs10760146 | hCV2783711 | rs10733650 | 0.51 | 0.849855381 | 0.9293 |
| hCV1632190 | rs10760146 | hCV29005933 | rs7042135 | 0.51 | 0.849855381 | 0.8947 |
| hCV1632190 | rs10760146 | hCV29005936 | rs6478498 | 0.51 | 0.849855381 | 0.8947 |
| hCV1632190 | rs10760146 | hCV29734592 | rs10435889 | 0.51 | 0.849855381 | 0.9272 |
| hCV1632190 | rs10760146 | hCV29824827 | rs9657673 | 0.51 | 0.849855381 | 1 |
| hCV1632190 | rs10760146 | hCV30041036 | rs10156476 | 0.51 | 0.849855381 | 1 |
| hCV1632190 | rs10760146 | hCV30167357 | rs7022941 | 0.51 | 0.849855381 | 1 |
| hCV1632190 | rs10760146 | hCV3045797 | rs7036541 | 0.51 | 0.849855381 | 1 |
| hCV1632190 | rs10760146 | hCV3045800 | rs3736855 | 0.51 | 0.849855381 | 1 |
| hCV1632190 | rs10760146 | hCV3045804 | rs2057467 | 0.51 | 0.849855381 | 0.9484 |
| hCV1632190 | rs10760146 | hCV3045808 | rs10818516 | 0.51 | 0.849855381 | 0.9294 |
| hCV1632190 | rs10760146 | hCV3045810 | rs2209076 | 0.51 | 0.849855381 | 0.9314 |
| hCV1632190 | rs10760146 | hCV30830415 | rs7855998 | 0.51 | 0.849855381 | 0.8947 |
| hCV1632190 | rs10760146 | hCV30830427 | rs10760142 | 0.51 | 0.849855381 | 0.8947 |
| hCV1632190 | rs10760146 | hCV30830440 | rs10760144 | 0.51 | 0.849855381 | 1 |
| hCV1632190 | rs10760146 | hCV30830506 | rs10760151 | 0.51 | 0.849855381 | 1 |
| hCV1632190 | rs10760146 | hCV30830537 | rs10818515 | 0.51 | 0.849855381 | 0.9646 |
| hCV1632190 | rs10760146 | hCV30830539 | rs10760153 | 0.51 | 0.849855381 | 0.9642 |
| hCV1632190 | rs10760146 | hCV30830540 | rs10760154 | 0.51 | 0.849855381 | 0.9649 |
| hCV1632190 | rs10760146 | hCV30830541 | rs10760155 | 0.51 | 0.849855381 | 0.9649 |
| hCV1632190 | rs10760146 | hCV30830542 | rs10760156 | 0.51 | 0.849855381 | 0.9628 |
| hCV1632190 | rs10760146 | hCV7577235 | rs1052508 | 0.51 | 0.849855381 | 0.9649 |
| hCV1632190 | rs10760146 | hCV7577248 | rs1359086 | 0.51 | 0.849855381 | 0.9314 |
| hCV1632190 | rs10760146 | hCV7577249 | rs1359085 | 0.51 | 0.849855381 | 0.9649 |
| hCV1632190 | rs10760146 | hCV7577337 | rs993247 | 0.51 | 0.849855381 | 0.9293 |
| hCV1761888 | rs1953126 | hCV11266229 | rs10435844 | 0.51 | 0.531539009 | 0.9666 |
| hCV1761888 | rs1953126 | hCV11266268 | rs10760121 | 0.51 | 0.531539009 | 1 |
| hCV1761888 | rs1953126 | hCV11720413 | rs1930782 | 0.51 | 0.531539009 | 0.6344 |
| hCV1761888 | rs1953126 | hCV11720414 | rs1930781 | 0.51 | 0.531539009 | 0.9666 |
| hCV1761888 | rs1953126 | hCV15849116 | rs2900180 | 0.51 | 0.531539009 | 0.9622 |
| hCV1761888 | rs1953126 | hCV15870898 | rs2072438 | 0.51 | 0.531539009 | 0.6691 |
| hCV1761888 | rs1953126 | hCV16124825 | rs2109895 | 0.51 | 0.531539009 | 0.9666 |
| hCV1761888 | rs1953126 | hCV16175379 | rs2239657 | 0.51 | 0.531539009 | 0.9341 |
| hCV1761888 | rs1953126 | hCV16234795 | rs2416804 | 0.51 | 0.531539009 | 0.6014 |
| hCV1761888 | rs1953126 | hCV1761891 | rs1930778 | 0.51 | 0.531539009 | 1 |
| hCV1761888 | rs1953126 | hCV1761894 | rs1609810 | 0.51 | 0.531539009 | 1 |

TABLE 4-continued

| Interrogated SNP | Interrogated rs | LD SNP | LD SNP rs | Power | Threshold r² | r² |
|---|---|---|---|---|---|---|
| hCV1761888 | rs1953126 | hCV2359565 | rs1014530 | 0.51 | 0.531539009 | 0.6344 |
| hCV1761888 | rs1953126 | hCV25751916 | rs10985070 | 0.51 | 0.531539009 | 0.6691 |
| hCV1761888 | rs1953126 | hCV2783582 | rs10818482 | 0.51 | 0.531539009 | 0.6691 |
| hCV1761888 | rs1953126 | hCV2783586 | rs2270231 | 0.51 | 0.531539009 | 1 |
| hCV1761888 | rs1953126 | hCV2783589 | rs881375 | 0.51 | 0.531539009 | 1 |
| hCV1761888 | rs1953126 | hCV2783590 | rs6478486 | 0.51 | 0.531539009 | 1 |
| hCV1761888 | rs1953126 | hCV2783591 | rs1468671 | 0.51 | 0.531539009 | 0.9666 |
| hCV1761888 | rs1953126 | hCV2783593 | rs1548783 | 0.51 | 0.531539009 | 0.9661 |
| hCV1761888 | rs1953126 | hCV2783597 | rs1860824 | 0.51 | 0.531539009 | 0.965 |
| hCV1761888 | rs1953126 | hCV2783599 | rs7046108 | 0.51 | 0.531539009 | 0.9666 |
| hCV1761888 | rs1953126 | hCV2783604 | rs10760126 | 0.51 | 0.531539009 | 0.6526 |
| hCV1761888 | rs1953126 | hCV2783607 | rs9886724 | 0.51 | 0.531539009 | 0.6785 |
| hCV1761888 | rs1953126 | hCV2783608 | rs4836834 | 0.51 | 0.531539009 | 0.6344 |
| hCV1761888 | rs1953126 | hCV2783609 | rs2241003 | 0.51 | 0.531539009 | 0.9321 |
| hCV1761888 | rs1953126 | hCV2783611 | rs10435843 | 0.51 | 0.531539009 | 0.9666 |
| hCV1761888 | rs1953126 | hCV2783618 | rs2239658 | 0.51 | 0.531539009 | 0.9666 |
| hCV1761888 | rs1953126 | hCV2783620 | rs7021880 | 0.51 | 0.531539009 | 0.8974 |
| hCV1761888 | rs1953126 | hCV2783621 | rs2416805 | 0.51 | 0.531539009 | 0.9666 |
| hCV1761888 | rs1953126 | hCV2783622 | rs758959 | 0.51 | 0.531539009 | 0.9666 |
| hCV1761888 | rs1953126 | hCV2783625 | rs10118357 | 0.51 | 0.531539009 | 0.6295 |
| hCV1761888 | rs1953126 | hCV2783630 | rs2269060 | 0.51 | 0.531539009 | 0.6344 |
| hCV1761888 | rs1953126 | hCV2783633 | rs7021049 | 0.51 | 0.531539009 | 0.6344 |
| hCV1761888 | rs1953126 | hCV2783634 | rs1014529 | 0.51 | 0.531539009 | 0.9666 |
| hCV1761888 | rs1953126 | hCV2783635 | rs1930780 | 0.51 | 0.531539009 | 0.9666 |
| hCV1761888 | rs1953126 | hCV2783638 | rs3761846 | 0.51 | 0.531539009 | 0.6344 |
| hCV1761888 | rs1953126 | hCV2783640 | rs3761847 | 0.51 | 0.531539009 | 0.6014 |
| hCV1761888 | rs1953126 | hCV2783641 | rs2416806 | 0.51 | 0.531539009 | 1 |
| hCV1761888 | rs1953126 | hCV2783647 | rs10739580 | 0.51 | 0.531539009 | 0.9666 |
| hCV1761888 | rs1953126 | hCV2783650 | rs10760129 | 0.51 | 0.531539009 | 0.6344 |
| hCV1761888 | rs1953126 | hCV2783653 | rs10760130 | 0.51 | 0.531539009 | 0.6344 |
| hCV1761888 | rs1953126 | hCV2783655 | rs10818488 | 0.51 | 0.531539009 | 0.6344 |
| hCV1761888 | rs1953126 | hCV2783656 | rs4837804 | 0.51 | 0.531539009 | 0.8593 |
| hCV1761888 | rs1953126 | hCV2783659 | rs7039505 | 0.51 | 0.531539009 | 0.9615 |
| hCV1761888 | rs1953126 | hCV29005976 | rs7037195 | 0.51 | 0.531539009 | 0.6344 |
| hCV1761888 | rs1953126 | hCV29005978 | rs7021206 | 0.51 | 0.531539009 | 0.9651 |
| hCV1761888 | rs1953126 | hCV29006006 | rs7034390 | 0.51 | 0.531539009 | 1 |
| hCV1761888 | rs1953126 | hCV30059070 | rs10156413 | 0.51 | 0.531539009 | 0.5621 |
| hCV1761888 | rs1953126 | hCV30830638 | rs10985073 | 0.51 | 0.531539009 | 0.6691 |
| hCV1761888 | rs1953126 | hCV30830725 | rs7864019 | 0.51 | 0.531539009 | 0.9666 |
| hCV1761888 | rs1953126 | hCV30830832 | rs10733648 | 0.51 | 0.531539009 | 0.9666 |
| hCV1761888 | rs1953126 | hCV30830909 | rs11794516 | 0.51 | 0.531539009 | 0.6691 |
| hCV1761888 | rs1953126 | hCV7577344 | rs876445 | 0.51 | 0.531539009 | 0.9666 |
| hCV1761894 | rs1609810 | hCV11266229 | rs10435844 | 0.51 | 0.449770851 | 0.9609 |
| hCV1761894 | rs1609810 | hCV11266268 | rs10760121 | 0.51 | 0.449770851 | 1 |
| hCV1761894 | rs1609810 | hCV11720350 | rs2057469 | 0.51 | 0.449770851 | 0.5389 |
| hCV1761894 | rs1609810 | hCV11720386 | rs1998506 | 0.51 | 0.449770851 | 0.5059 |
| hCV1761894 | rs1609810 | hCV11720394 | rs1924081 | 0.51 | 0.449770851 | 0.4793 |
| hCV1761894 | rs1609810 | hCV11720413 | rs1930782 | 0.51 | 0.449770851 | 0.6068 |
| hCV1761894 | rs1609810 | hCV11720414 | rs1930781 | 0.51 | 0.449770851 | 0.9609 |
| hCV1761894 | rs1609810 | hCV15849105 | rs2900185 | 0.51 | 0.449770851 | 0.5717 |
| hCV1761894 | rs1609810 | hCV15849116 | rs2900180 | 0.51 | 0.449770851 | 0.9559 |
| hCV1761894 | rs1609810 | hCV15870898 | rs2072438 | 0.51 | 0.449770851 | 0.6485 |
| hCV1761894 | rs1609810 | hCV16124825 | rs2109895 | 0.51 | 0.449770851 | 0.9609 |
| hCV1761894 | rs1609810 | hCV16175379 | rs2239657 | 0.51 | 0.449770851 | 0.9609 |
| hCV1761894 | rs1609810 | hCV16180474 | rs2273988 | 0.51 | 0.449770851 | 0.4757 |
| hCV1761894 | rs1609810 | hCV16234795 | rs2416804 | 0.51 | 0.449770851 | 0.6068 |
| hCV1761894 | rs1609810 | hCV16234838 | rs2416819 | 0.51 | 0.449770851 | 0.5389 |
| hCV1761894 | rs1609810 | hCV16234840 | rs2416817 | 0.51 | 0.449770851 | 0.5717 |
| hCV1761894 | rs1609810 | hCV1632195 | rs1998505 | 0.51 | 0.449770851 | 0.5717 |
| hCV1761894 | rs1609810 | hCV1632205 | rs10818509 | 0.51 | 0.449770851 | 0.5059 |
| hCV1761894 | rs1609810 | hCV1761888 | rs1953126 | 0.51 | 0.449770851 | 1 |
| hCV1761894 | rs1609810 | hCV1761891 | rs1930778 | 0.51 | 0.449770851 | 1 |
| hCV1761894 | rs1609810 | hCV2359565 | rs1014530 | 0.51 | 0.449770851 | 0.6068 |
| hCV1761894 | rs1609810 | hCV25472748 | rs10760138 | 0.51 | 0.449770851 | 0.4707 |
| hCV1761894 | rs1609810 | hCV25613469 | rs10760157 | 0.51 | 0.449770851 | 0.5389 |
| hCV1761894 | rs1609810 | hCV25746749 | rs7023214 | 0.51 | 0.449770851 | 0.5059 |
| hCV1761894 | rs1609810 | hCV25751916 | rs10985070 | 0.51 | 0.449770851 | 0.6485 |
| hCV1761894 | rs1609810 | hCV25771057 | rs10760150 | 0.51 | 0.449770851 | 0.5717 |
| hCV1761894 | rs1609810 | hCV25969661 | rs10818503 | 0.51 | 0.449770851 | 0.5059 |
| hCV1761894 | rs1609810 | hCV26144328 | rs4836841 | 0.51 | 0.449770851 | 0.4757 |
| hCV1761894 | rs1609810 | hCV2783582 | rs10818482 | 0.51 | 0.449770851 | 0.6485 |
| hCV1761894 | rs1609810 | hCV2783586 | rs2270231 | 0.51 | 0.449770851 | 1 |
| hCV1761894 | rs1609810 | hCV2783589 | rs881375 | 0.51 | 0.449770851 | 1 |
| hCV1761894 | rs1609810 | hCV2783590 | rs6478486 | 0.51 | 0.449770851 | 1 |
| hCV1761894 | rs1609810 | hCV2783591 | rs1468671 | 0.51 | 0.449770851 | 0.9609 |
| hCV1761894 | rs1609810 | hCV2783593 | rs1548783 | 0.51 | 0.449770851 | 0.9603 |
| hCV1761894 | rs1609810 | hCV2783597 | rs1860824 | 0.51 | 0.449770851 | 0.9588 |

TABLE 4-continued

| Interrogated SNP | Interrogated rs | LD SNP | LD SNP rs | Power | Threshold r² | r² |
|---|---|---|---|---|---|---|
| hCV1761894 | rs1609810 | hCV2783599 | rs7046108 | 0.51 | 0.449770851 | 0.9609 |
| hCV1761894 | rs1609810 | hCV2783604 | rs10760126 | 0.51 | 0.449770851 | 0.6271 |
| hCV1761894 | rs1609810 | hCV2783607 | rs9886724 | 0.51 | 0.449770851 | 0.6581 |
| hCV1761894 | rs1609810 | hCV2783608 | rs4836834 | 0.51 | 0.449770851 | 0.6068 |
| hCV1761894 | rs1609810 | hCV2783609 | rs2241003 | 0.51 | 0.449770851 | 0.9205 |
| hCV1761894 | rs1609810 | hCV2783611 | rs10435843 | 0.51 | 0.449770851 | 0.9609 |
| hCV1761894 | rs1609810 | hCV2783618 | rs2239658 | 0.51 | 0.449770851 | 0.9609 |
| hCV1761894 | rs1609810 | hCV2783620 | rs7021880 | 0.51 | 0.449770851 | 0.8797 |
| hCV1761894 | rs1609810 | hCV2783621 | rs2416805 | 0.51 | 0.449770851 | 0.9609 |
| hCV1761894 | rs1609810 | hCV2783622 | rs758959 | 0.51 | 0.449770851 | 0.9609 |
| hCV1761894 | rs1609810 | hCV2783625 | rs10118357 | 0.51 | 0.449770851 | 0.6003 |
| hCV1761894 | rs1609810 | hCV2783630 | rs2269060 | 0.51 | 0.449770851 | 0.6068 |
| hCV1761894 | rs1609810 | hCV2783633 | rs7021049 | 0.51 | 0.449770851 | 0.6068 |
| hCV1761894 | rs1609810 | hCV2783634 | rs1014529 | 0.51 | 0.449770851 | 0.9609 |
| hCV1761894 | rs1609810 | hCV2783635 | rs1930780 | 0.51 | 0.449770851 | 0.9609 |
| hCV1761894 | rs1609810 | hCV2783638 | rs3761846 | 0.51 | 0.449770851 | 0.6068 |
| hCV1761894 | rs1609810 | hCV2783640 | rs3761847 | 0.51 | 0.449770851 | 0.5676 |
| hCV1761894 | rs1609810 | hCV2783641 | rs2416806 | 0.51 | 0.449770851 | 1 |
| hCV1761894 | rs1609810 | hCV2783647 | rs10739580 | 0.51 | 0.449770851 | 0.9609 |
| hCV1761894 | rs1609810 | hCV2783650 | rs10760129 | 0.51 | 0.449770851 | 0.6068 |
| hCV1761894 | rs1609810 | hCV2783653 | rs10760130 | 0.51 | 0.449770851 | 0.6068 |
| hCV1761894 | rs1609810 | hCV2783655 | rs10818488 | 0.51 | 0.449770851 | 0.6068 |
| hCV1761894 | rs1609810 | hCV2783656 | rs4837804 | 0.51 | 0.449770851 | 0.8728 |
| hCV1761894 | rs1609810 | hCV2783659 | rs7039505 | 0.51 | 0.449770851 | 0.9563 |
| hCV1761894 | rs1609810 | hCV27912350 | rs4837808 | 0.51 | 0.449770851 | 0.5717 |
| hCV1761894 | rs1609810 | hCV27912351 | rs4837809 | 0.51 | 0.449770851 | 0.5717 |
| hCV1761894 | rs1609810 | hCV29005922 | rs7033790 | 0.51 | 0.449770851 | 0.4793 |
| hCV1761894 | rs1609810 | hCV29005923 | rs6478494 | 0.51 | 0.449770851 | 0.4707 |
| hCV1761894 | rs1609810 | hCV29005924 | rs7031128 | 0.51 | 0.449770851 | 0.5015 |
| hCV1761894 | rs1609810 | hCV29005931 | rs6478496 | 0.51 | 0.449770851 | 0.4793 |
| hCV1761894 | rs1609810 | hCV29005938 | rs7856420 | 0.51 | 0.449770851 | 0.5059 |
| hCV1761894 | rs1609810 | hCV29005976 | rs7037195 | 0.51 | 0.449770851 | 0.6068 |
| hCV1761894 | rs1609810 | hCV29005978 | rs7021206 | 0.51 | 0.449770851 | 0.9588 |
| hCV1761894 | rs1609810 | hCV29006006 | rs7034390 | 0.51 | 0.449770851 | 1 |
| hCV1761894 | rs1609810 | hCV30059070 | rs10156413 | 0.51 | 0.449770851 | 0.6789 |
| hCV1761894 | rs1609810 | hCV30293181 | rs10081760 | 0.51 | 0.449770851 | 0.5042 |
| hCV1761894 | rs1609810 | hCV3045792 | rs6478499 | 0.51 | 0.449770851 | 0.5955 |
| hCV1761894 | rs1609810 | hCV3045801 | rs2057465 | 0.51 | 0.449770851 | 0.5261 |
| hCV1761894 | rs1609810 | hCV3045802 | rs2057466 | 0.51 | 0.449770851 | 0.4757 |
| hCV1761894 | rs1609810 | hCV3045803 | rs2146836 | 0.51 | 0.449770851 | 0.4757 |
| hCV1761894 | rs1609810 | hCV30527383 | rs9644911 | 0.51 | 0.449770851 | 0.4667 |
| hCV1761894 | rs1609810 | hCV30563728 | rs10156396 | 0.51 | 0.449770851 | 0.4753 |
| hCV1761894 | rs1609810 | hCV30563729 | rs9299273 | 0.51 | 0.449770851 | 0.5717 |
| hCV1761894 | rs1609810 | hCV30830342 | rs7040319 | 0.51 | 0.449770851 | 0.4529 |
| hCV1761894 | rs1609810 | hCV30830395 | rs10985132 | 0.51 | 0.449770851 | 0.4793 |
| hCV1761894 | rs1609810 | hCV30830397 | rs10760139 | 0.51 | 0.449770851 | 0.4793 |
| hCV1761894 | rs1609810 | hCV30830406 | rs7040603 | 0.51 | 0.449770851 | 0.4793 |
| hCV1761894 | rs1609810 | hCV30830407 | rs10739585 | 0.51 | 0.449770851 | 0.4793 |
| hCV1761894 | rs1609810 | hCV30830414 | rs7871371 | 0.51 | 0.449770851 | 0.4949 |
| hCV1761894 | rs1609810 | hCV30830417 | rs7029523 | 0.51 | 0.449770851 | 0.4793 |
| hCV1761894 | rs1609810 | hCV30830435 | rs10739586 | 0.51 | 0.449770851 | 0.5059 |
| hCV1761894 | rs1609810 | hCV30830458 | rs10733651 | 0.51 | 0.449770851 | 0.5059 |
| hCV1761894 | rs1609810 | hCV30830468 | rs10818507 | 0.51 | 0.449770851 | 0.5876 |
| hCV1761894 | rs1609810 | hCV30830473 | rs7036649 | 0.51 | 0.449770851 | 0.5901 |
| hCV1761894 | rs1609810 | hCV30830475 | rs10733652 | 0.51 | 0.449770851 | 0.5508 |
| hCV1761894 | rs1609810 | hCV30830484 | rs10818508 | 0.51 | 0.449770851 | 0.5717 |
| hCV1761894 | rs1609810 | hCV30830486 | rs10760149 | 0.51 | 0.449770851 | 0.5717 |
| hCV1761894 | rs1609810 | hCV30830503 | rs4837811 | 0.51 | 0.449770851 | 0.5717 |
| hCV1761894 | rs1609810 | hCV30830512 | rs10818512 | 0.51 | 0.449770851 | 0.5389 |
| hCV1761894 | rs1609810 | hCV30830521 | rs10818513 | 0.51 | 0.449770851 | 0.5389 |
| hCV1761894 | rs1609810 | hCV30830536 | rs7047038 | 0.51 | 0.449770851 | 0.5389 |
| hCV1761894 | rs1609810 | hCV30830538 | rs10760152 | 0.51 | 0.449770851 | 0.4679 |
| hCV1761894 | rs1609810 | hCV30830638 | rs10985073 | 0.51 | 0.449770851 | 0.6485 |
| hCV1761894 | rs1609810 | hCV30830725 | rs7864019 | 0.51 | 0.449770851 | 0.9609 |
| hCV1761894 | rs1609810 | hCV30830832 | rs10733648 | 0.51 | 0.449770851 | 0.9609 |
| hCV1761894 | rs1609810 | hCV30830909 | rs11794516 | 0.51 | 0.449770851 | 0.6485 |
| hCV1761894 | rs1609810 | hCV7577250 | rs942153 | 0.51 | 0.449770851 | 0.5389 |
| hCV1761894 | rs1609810 | hCV7577271 | rs1535655 | 0.51 | 0.449770851 | 0.5389 |
| hCV1761894 | rs1609810 | hCV7577286 | rs1407912 | 0.51 | 0.449770851 | 0.5059 |
| hCV1761894 | rs1609810 | hCV7577287 | rs1323478 | 0.51 | 0.449770851 | 0.5717 |
| hCV1761894 | rs1609810 | hCV7577296 | rs1407910 | 0.51 | 0.449770851 | 0.5717 |
| hCV1761894 | rs1609810 | hCV7577311 | rs1323473 | 0.51 | 0.449770851 | 0.4864 |
| hCV1761894 | rs1609810 | hCV7577328 | rs1323476 | 0.51 | 0.449770851 | 0.4793 |
| hCV1761894 | rs1609810 | hCV7577332 | rs1468672 | 0.51 | 0.449770851 | 0.4793 |
| hCV1761894 | rs1609810 | hCV7577344 | rs876445 | 0.51 | 0.449770851 | 0.9609 |
| hCV1761894 | rs1609810 | hCV782872 | rs758958 | 0.51 | 0.449770851 | 0.4793 |
| hCV1917481 | rs10760112 | hCV11297574 | rs10760113 | 0.51 | 0.449378359 | 1 |

TABLE 4-continued

| Interrogated SNP | Interrogated rs | LD SNP | LD SNP rs | Power | Threshold r² | r² |
|---|---|---|---|---|---|---|
| hCV1917481 | rs10760112 | hCV1452630 | rs10818476 | 0.51 | 0.449378359 | 0.4938 |
| hCV1917481 | rs10760112 | hCV1452651 | rs3793638 | 0.51 | 0.449378359 | 0.5136 |
| hCV1917481 | rs10760112 | hCV1452652 | rs1060817 | 0.51 | 0.449378359 | 0.5136 |
| hCV1917481 | rs10760112 | hCV1452665 | rs4837796 | 0.51 | 0.449378359 | 0.4938 |
| hCV1917481 | rs10760112 | hCV15849071 | rs2900177 | 0.51 | 0.449378359 | 0.9558 |
| hCV1917481 | rs10760112 | hCV1917479 | rs10984994 | 0.51 | 0.449378359 | 0.9632 |
| hCV1917481 | rs10760112 | hCV1917497 | rs10491784 | 0.51 | 0.449378359 | 1 |
| hCV1917481 | rs10760112 | hCV1917498 | rs920745 | 0.51 | 0.449378359 | 1 |
| hCV1917481 | rs10760112 | hCV1917499 | rs1867254 | 0.51 | 0.449378359 | 1 |
| hCV1917481 | rs10760112 | hCV1917500 | rs4837789 | 0.51 | 0.449378359 | 1 |
| hCV1917481 | rs10760112 | hCV1917502 | rs10984974 | 0.51 | 0.449378359 | 1 |
| hCV1917481 | rs10760112 | hCV1917505 | rs10760110 | 0.51 | 0.449378359 | 0.9632 |
| hCV1917481 | rs10760112 | hCV1917506 | rs10984972 | 0.51 | 0.449378359 | 0.9632 |
| hCV1917481 | rs10760112 | hCV22272588 | rs10760117 | 0.51 | 0.449378359 | 0.4938 |
| hCV1917481 | rs10760112 | hCV25758615 | rs7849566 | 0.51 | 0.449378359 | 1 |
| hCV1917481 | rs10760112 | hCV26144235 | rs1886337 | 0.51 | 0.449378359 | 1 |
| hCV1917481 | rs10760112 | hCV26144244 | rs4837792 | 0.51 | 0.449378359 | 0.9632 |
| hCV1917481 | rs10760112 | hCV26144245 | rs4837793 | 0.51 | 0.449378359 | 0.9632 |
| hCV1917481 | rs10760112 | hCV26144246 | rs4836830 | 0.51 | 0.449378359 | 0.9632 |
| hCV1917481 | rs10760112 | hCV27912345 | rs4142158 | 0.51 | 0.449378359 | 0.9632 |
| hCV1917481 | rs10760112 | hCV29005915 | rs7044106 | 0.51 | 0.449378359 | 0.7043 |
| hCV1917481 | rs10760112 | hCV30419540 | rs10491783 | 0.51 | 0.449378359 | 1 |
| hCV1917481 | rs10760112 | hCV30829523 | rs12343516 | 0.51 | 0.449378359 | 0.5136 |
| hCV1917481 | rs10760112 | hCV30830175 | rs10739569 | 0.51 | 0.449378359 | 0.7841 |
| hCV1917481 | rs10760112 | hCV30830228 | rs7024046 | 0.51 | 0.449378359 | 1 |
| hCV1917481 | rs10760112 | hCV30830259 | rs7044226 | 0.51 | 0.449378359 | 1 |
| hCV1917481 | rs10760112 | hCV30830283 | rs10818474 | 0.51 | 0.449378359 | 0.6426 |
| hCV1917481 | rs10760112 | hCV30830295 | rs7033339 | 0.51 | 0.449378359 | 0.79 |
| hCV1917481 | rs10760112 | hCV3121925 | rs4836831 | 0.51 | 0.449378359 | 0.9621 |
| hCV1917481 | rs10760112 | hCV3121928 | rs10985009 | 0.51 | 0.449378359 | 0.9632 |
| hCV1917481 | rs10760112 | hCV3121936 | rs735110 | 0.51 | 0.449378359 | 0.9632 |
| hCV1917481 | rs10760112 | hCV3121937 | rs735109 | 0.51 | 0.449378359 | 0.9632 |
| hCV1917481 | rs10760112 | hCV3121938 | rs747819 | 0.51 | 0.449378359 | 0.9632 |
| hCV1917481 | rs10760112 | hCV3121944 | rs2416799 | 0.51 | 0.449378359 | 0.9632 |
| hCV1917481 | rs10760112 | hCV3121945 | rs4617229 | 0.51 | 0.449378359 | 0.9632 |
| hCV1917481 | rs10760112 | hCV3121960 | rs966397 | 0.51 | 0.449378359 | 1 |
| hCV1917481 | rs10760112 | hCV3121961 | rs966396 | 0.51 | 0.449378359 | 1 |
| hCV1917481 | rs10760112 | hCV3121962 | rs4837790 | 0.51 | 0.449378359 | 1 |
| hCV1917481 | rs10760112 | hCV3121966 | rs1158553 | 0.51 | 0.449378359 | 1 |
| hCV1917481 | rs10760112 | hCV3121967 | rs1158554 | 0.51 | 0.449378359 | 1 |
| hCV1917481 | rs10760112 | hCV3121972 | rs7357638 | 0.51 | 0.449378359 | 1 |
| hCV1917481 | rs10760112 | hCV3121975 | rs1981021 | 0.51 | 0.449378359 | 1 |
| hCV1917481 | rs10760112 | hCV3121979 | rs3903886 | 0.51 | 0.449378359 | 0.9632 |
| hCV1917481 | rs10760112 | hCV3121981 | rs10739570 | 0.51 | 0.449378359 | 0.9632 |
| hCV1917481 | rs10760112 | hCV3121982 | rs7861679 | 0.51 | 0.449378359 | 0.8916 |
| hCV1917481 | rs10760112 | hCV3121983 | rs2416760 | 0.51 | 0.449378359 | 0.8916 |
| hCV1917481 | rs10760112 | hCV3121984 | rs991121 | 0.51 | 0.449378359 | 0.8904 |
| hCV1917481 | rs10760112 | hCV3121985 | rs959558 | 0.51 | 0.449378359 | 0.8916 |
| hCV1917481 | rs10760112 | hCV3121987 | rs10616 | 0.51 | 0.449378359 | 0.82 |
| hCV1917481 | rs10760112 | hCV3121993 | rs7042649 | 0.51 | 0.449378359 | 0.5072 |
| hCV1917481 | rs10760112 | hCV7577356 | rs1530370 | 0.51 | 0.449378359 | 1 |
| hCV1917481 | rs10760112 | hCV7577357 | rs1547267 | 0.51 | 0.449378359 | 0.9632 |
| hCV1917481 | rs10760112 | hCV7577359 | rs1324473 | 0.51 | 0.449378359 | 1 |
| hCV1917481 | rs10760112 | hCV7577376 | rs1359329 | 0.51 | 0.449378359 | 0.509 |
| hCV1917481 | rs10760112 | hCV7577377 | rs1359328 | 0.51 | 0.449378359 | 0.7201 |
| hCV22272588 | rs10760117 | hCV11266229 | rs10435844 | 0.51 | 0.29326589 | 0.3629 |
| hCV22272588 | rs10760117 | hCV11266268 | rs10760121 | 0.51 | 0.29326589 | 0.3842 |
| hCV22272588 | rs10760117 | hCV11297574 | rs10760113 | 0.51 | 0.29326589 | 0.4666 |
| hCV22272588 | rs10760117 | hCV11720413 | rs1930782 | 0.51 | 0.29326589 | 0.3495 |
| hCV22272588 | rs10760117 | hCV11720414 | rs1930781 | 0.51 | 0.29326589 | 0.3629 |
| hCV22272588 | rs10760117 | hCV1452630 | rs10818476 | 0.51 | 0.29326589 | 1 |
| hCV22272588 | rs10760117 | hCV1452651 | rs3793638 | 0.51 | 0.29326589 | 0.9672 |
| hCV22272588 | rs10760117 | hCV1452652 | rs1060817 | 0.51 | 0.29326589 | 0.9672 |
| hCV22272588 | rs10760117 | hCV1452665 | rs4837796 | 0.51 | 0.29326589 | 1 |
| hCV22272588 | rs10760117 | hCV15849071 | rs2900177 | 0.51 | 0.29326589 | 0.51 |
| hCV22272588 | rs10760117 | hCV15849116 | rs2900180 | 0.51 | 0.29326589 | 0.3765 |
| hCV22272588 | rs10760117 | hCV15870898 | rs2072438 | 0.51 | 0.29326589 | 0.3756 |
| hCV22272588 | rs10760117 | hCV16124825 | rs2109895 | 0.51 | 0.29326589 | 0.3629 |
| hCV22272588 | rs10760117 | hCV16175379 | rs2239657 | 0.51 | 0.29326589 | 0.3395 |
| hCV22272588 | rs10760117 | hCV16234795 | rs2416804 | 0.51 | 0.29326589 | 0.3275 |
| hCV22272588 | rs10760117 | hCV16234804 | rs2416800 | 0.51 | 0.29326589 | 0.7916 |
| hCV22272588 | rs10760117 | hCV1761881 | rs3933326 | 0.51 | 0.29326589 | 0.5095 |
| hCV22272588 | rs10760117 | hCV1761888 | rs1953126 | 0.51 | 0.29326589 | 0.3842 |
| hCV22272588 | rs10760117 | hCV1761891 | rs1930778 | 0.51 | 0.29326589 | 0.3302 |
| hCV22272588 | rs10760117 | hCV1761894 | rs1609810 | 0.51 | 0.29326589 | 0.3612 |
| hCV22272588 | rs10760117 | hCV1917479 | rs10984994 | 0.51 | 0.29326589 | 0.4997 |
| hCV22272588 | rs10760117 | hCV1917481 | rs10760112 | 0.51 | 0.29326589 | 0.4938 |

TABLE 4-continued

| Interrogated SNP | Interrogated rs | LD SNP | LD SNP rs | Power | Threshold r² | r² |
|---|---|---|---|---|---|---|
| hCV22272588 | rs10760117 | hCV1917497 | rs10491784 | 0.51 | 0.29326589 | 0.4666 |
| hCV22272588 | rs10760117 | hCV1917498 | rs920745 | 0.51 | 0.29326589 | 0.4666 |
| hCV22272588 | rs10760117 | hCV1917499 | rs1867254 | 0.51 | 0.29326589 | 0.4666 |
| hCV22272588 | rs10760117 | hCV1917500 | rs4837789 | 0.51 | 0.29326589 | 0.4666 |
| hCV22272588 | rs10760117 | hCV1917502 | rs10984974 | 0.51 | 0.29326589 | 0.4666 |
| hCV22272588 | rs10760117 | hCV1917505 | rs10760110 | 0.51 | 0.29326589 | 0.4475 |
| hCV22272588 | rs10760117 | hCV1917506 | rs10984972 | 0.51 | 0.29326589 | 0.4475 |
| hCV22272588 | rs10760117 | hCV2359565 | rs1014530 | 0.51 | 0.29326589 | 0.3495 |
| hCV22272588 | rs10760117 | hCV25612709 | rs7026635 | 0.51 | 0.29326589 | 0.5345 |
| hCV22272588 | rs10760117 | hCV25751916 | rs10985070 | 0.51 | 0.29326589 | 0.3756 |
| hCV22272588 | rs10760117 | hCV25757804 | rs4836833 | 0.51 | 0.29326589 | 0.4886 |
| hCV22272588 | rs10760117 | hCV25758615 | rs7849566 | 0.51 | 0.29326589 | 0.4666 |
| hCV22272588 | rs10760117 | hCV26144018 | rs10739575 | 0.51 | 0.29326589 | 0.3407 |
| hCV22272588 | rs10760117 | hCV26144235 | rs1886337 | 0.51 | 0.29326589 | 0.4666 |
| hCV22272588 | rs10760117 | hCV26144244 | rs4837792 | 0.51 | 0.29326589 | 0.4997 |
| hCV22272588 | rs10760117 | hCV26144245 | rs4837793 | 0.51 | 0.29326589 | 0.4997 |
| hCV22272588 | rs10760117 | hCV26144246 | rs4836830 | 0.51 | 0.29326589 | 0.4997 |
| hCV22272588 | rs10760117 | hCV2783582 | rs10818482 | 0.51 | 0.29326589 | 0.3756 |
| hCV22272588 | rs10760117 | hCV2783586 | rs2270231 | 0.51 | 0.29326589 | 0.3842 |
| hCV22272588 | rs10760117 | hCV2783589 | rs881375 | 0.51 | 0.29326589 | 0.3842 |
| hCV22272588 | rs10760117 | hCV2783590 | rs6478486 | 0.51 | 0.29326589 | 0.3842 |
| hCV22272588 | rs10760117 | hCV2783591 | rs1468671 | 0.51 | 0.29326589 | 0.3629 |
| hCV22272588 | rs10760117 | hCV2783593 | rs1548783 | 0.51 | 0.29326589 | 0.3754 |
| hCV22272588 | rs10760117 | hCV2783597 | rs1860824 | 0.51 | 0.29326589 | 0.3376 |
| hCV22272588 | rs10760117 | hCV2783599 | rs7046108 | 0.51 | 0.29326589 | 0.3629 |
| hCV22272588 | rs10760117 | hCV2783604 | rs10760126 | 0.51 | 0.29326589 | 0.362 |
| hCV22272588 | rs10760117 | hCV2783607 | rs9886724 | 0.51 | 0.29326589 | 0.3695 |
| hCV22272588 | rs10760117 | hCV2783608 | rs4836834 | 0.51 | 0.29326589 | 0.3495 |
| hCV22272588 | rs10760117 | hCV2783609 | rs2241003 | 0.51 | 0.29326589 | 0.406 |
| hCV22272588 | rs10760117 | hCV2783611 | rs10435843 | 0.51 | 0.29326589 | 0.3629 |
| hCV22272588 | rs10760117 | hCV2783618 | rs2239658 | 0.51 | 0.29326589 | 0.3629 |
| hCV22272588 | rs10760117 | hCV2783620 | rs7021880 | 0.51 | 0.29326589 | 0.3276 |
| hCV22272588 | rs10760117 | hCV2783621 | rs2416805 | 0.51 | 0.29326589 | 0.3629 |
| hCV22272588 | rs10760117 | hCV2783622 | rs758959 | 0.51 | 0.29326589 | 0.3629 |
| hCV22272588 | rs10760117 | hCV2783625 | rs10118357 | 0.51 | 0.29326589 | 0.3662 |
| hCV22272588 | rs10760117 | hCV2783630 | rs2269060 | 0.51 | 0.29326589 | 0.3495 |
| hCV22272588 | rs10760117 | hCV2783633 | rs7021049 | 0.51 | 0.29326589 | 0.3495 |
| hCV22272588 | rs10760117 | hCV2783634 | rs1014529 | 0.51 | 0.29326589 | 0.3629 |
| hCV22272588 | rs10760117 | hCV2783635 | rs1930780 | 0.51 | 0.29326589 | 0.3629 |
| hCV22272588 | rs10760117 | hCV2783638 | rs3761846 | 0.51 | 0.29326589 | 0.3495 |
| hCV22272588 | rs10760117 | hCV2783640 | rs3761847 | 0.51 | 0.29326589 | 0.3275 |
| hCV22272588 | rs10760117 | hCV2783641 | rs2416806 | 0.51 | 0.29326589 | 0.3646 |
| hCV22272588 | rs10760117 | hCV2783647 | rs10739580 | 0.51 | 0.29326589 | 0.3629 |
| hCV22272588 | rs10760117 | hCV2783650 | rs10760129 | 0.51 | 0.29326589 | 0.3495 |
| hCV22272588 | rs10760117 | hCV2783653 | rs10760130 | 0.51 | 0.29326589 | 0.3495 |
| hCV22272588 | rs10760117 | hCV2783655 | rs10818488 | 0.51 | 0.29326589 | 0.3495 |
| hCV22272588 | rs10760117 | hCV2783656 | rs4837804 | 0.51 | 0.29326589 | 0.3051 |
| hCV22272588 | rs10760117 | hCV2783659 | rs7039505 | 0.51 | 0.29326589 | 0.3838 |
| hCV22272588 | rs10760117 | hCV27912345 | rs4142158 | 0.51 | 0.29326589 | 0.4475 |
| hCV22272588 | rs10760117 | hCV29005915 | rs7044106 | 0.51 | 0.29326589 | 0.3396 |
| hCV22272588 | rs10760117 | hCV29005976 | rs7037195 | 0.51 | 0.29326589 | 0.3495 |
| hCV22272588 | rs10760117 | hCV29005978 | rs7021206 | 0.51 | 0.29326589 | 0.3583 |
| hCV22272588 | rs10760117 | hCV29006006 | rs7034390 | 0.51 | 0.29326589 | 0.3842 |
| hCV22272588 | rs10760117 | hCV30419540 | rs10491783 | 0.51 | 0.29326589 | 0.4666 |
| hCV22272588 | rs10760117 | hCV30829523 | rs12343516 | 0.51 | 0.29326589 | 0.9672 |
| hCV22272588 | rs10760117 | hCV30830175 | rs10739569 | 0.51 | 0.29326589 | 0.3535 |
| hCV22272588 | rs10760117 | hCV30830228 | rs7024046 | 0.51 | 0.29326589 | 0.4666 |
| hCV22272588 | rs10760117 | hCV30830259 | rs7044226 | 0.51 | 0.29326589 | 0.5063 |
| hCV22272588 | rs10760117 | hCV30830283 | rs10818474 | 0.51 | 0.29326589 | 0.3723 |
| hCV22272588 | rs10760117 | hCV30830295 | rs7033339 | 0.51 | 0.29326589 | 0.4533 |
| hCV22272588 | rs10760117 | hCV30830638 | rs10985073 | 0.51 | 0.29326589 | 0.3756 |
| hCV22272588 | rs10760117 | hCV30830725 | rs7864019 | 0.51 | 0.29326589 | 0.3629 |
| hCV22272588 | rs10760117 | hCV30830832 | rs10733648 | 0.51 | 0.29326589 | 0.3629 |
| hCV22272588 | rs10760117 | hCV30830909 | rs11794516 | 0.51 | 0.29326589 | 0.3756 |
| hCV22272588 | rs10760117 | hCV3121925 | rs4836831 | 0.51 | 0.29326589 | 0.4882 |
| hCV22272588 | rs10760117 | hCV3121928 | rs10985009 | 0.51 | 0.29326589 | 0.4997 |
| hCV22272588 | rs10760117 | hCV3121936 | rs735110 | 0.51 | 0.29326589 | 0.4997 |
| hCV22272588 | rs10760117 | hCV3121937 | rs735109 | 0.51 | 0.29326589 | 0.4997 |
| hCV22272588 | rs10760117 | hCV3121938 | rs747819 | 0.51 | 0.29326589 | 0.4997 |
| hCV22272588 | rs10760117 | hCV3121944 | rs2416799 | 0.51 | 0.29326589 | 0.4997 |
| hCV22272588 | rs10760117 | hCV3121945 | rs4617229 | 0.51 | 0.29326589 | 0.4997 |
| hCV22272588 | rs10760117 | hCV3121960 | rs966397 | 0.51 | 0.29326589 | 0.4666 |
| hCV22272588 | rs10760117 | hCV3121961 | rs966396 | 0.51 | 0.29326589 | 0.4666 |
| hCV22272588 | rs10760117 | hCV3121962 | rs4837790 | 0.51 | 0.29326589 | 0.4666 |
| hCV22272588 | rs10760117 | hCV3121966 | rs1158553 | 0.51 | 0.29326589 | 0.4666 |
| hCV22272588 | rs10760117 | hCV3121967 | rs1158554 | 0.51 | 0.29326589 | 0.4666 |
| hCV22272588 | rs10760117 | hCV3121972 | rs7357638 | 0.51 | 0.29326589 | 0.4666 |

TABLE 4-continued

| Interrogated SNP | Interrogated rs | LD SNP | LD SNP rs | Power | Threshold r² | r² |
|---|---|---|---|---|---|---|
| hCV22272588 | rs10760117 | hCV3121975 | rs1981021 | 0.51 | 0.29326589 | 0.4666 |
| hCV22272588 | rs10760117 | hCV3121979 | rs3903886 | 0.51 | 0.29326589 | 0.4457 |
| hCV22272588 | rs10760117 | hCV3121981 | rs10739570 | 0.51 | 0.29326589 | 0.4457 |
| hCV22272588 | rs10760117 | hCV3121982 | rs7861679 | 0.51 | 0.29326589 | 0.3854 |
| hCV22272588 | rs10760117 | hCV3121983 | rs2416760 | 0.51 | 0.29326589 | 0.3854 |
| hCV22272588 | rs10760117 | hCV3121984 | rs991121 | 0.51 | 0.29326589 | 0.3774 |
| hCV22272588 | rs10760117 | hCV3121985 | rs959558 | 0.51 | 0.29326589 | 0.3854 |
| hCV22272588 | rs10760117 | hCV3121987 | rs10616 | 0.51 | 0.29326589 | 0.3448 |
| hCV22272588 | rs10760117 | hCV3121993 | rs7042649 | 0.51 | 0.29326589 | 0.3817 |
| hCV22272588 | rs10760117 | hCV7577344 | rs876445 | 0.51 | 0.29326589 | 0.3629 |
| hCV22272588 | rs10760117 | hCV7577356 | rs1530370 | 0.51 | 0.29326589 | 0.4666 |
| hCV22272588 | rs10760117 | hCV7577357 | rs1547267 | 0.51 | 0.29326589 | 0.4475 |
| hCV22272588 | rs10760117 | hCV7577359 | rs1324473 | 0.51 | 0.29326589 | 0.4666 |
| hCV22272588 | rs10760117 | hCV7577377 | rs1359328 | 0.51 | 0.29326589 | 0.2949 |
| hCV22272588 | rs10760117 | hCV8780517 | rs1056567 | 0.51 | 0.29326589 | 0.4886 |
| hCV22272588 | rs10760117 | hCV8780961 | rs914842 | 0.51 | 0.29326589 | 0.3563 |
| hCV22272588 | rs10760117 | hCV8780962 | rs1837 | 0.51 | 0.29326589 | 0.4622 |
| hCV25612709 | rs7026635 | hCV1761881 | rs3933326 | 0.51 | 0.604602471 | 0.7321 |
| hCV25612709 | rs7026635 | hCV25757804 | rs4836833 | 0.51 | 0.604602471 | 0.7608 |
| hCV25612709 | rs7026635 | hCV26144018 | rs10739575 | 0.51 | 0.604602471 | 0.6374 |
| hCV25612709 | rs7026635 | hCV8780517 | rs1056567 | 0.51 | 0.604602471 | 0.7608 |
| hCV25612709 | rs7026635 | hCV8780961 | rs914842 | 0.51 | 0.604602471 | 0.6667 |
| hCV25612709 | rs7026635 | hCV8780962 | rs1837 | 0.51 | 0.604602471 | 0.8902 |
| hCV25751916 | rs10985070 | hCV11266229 | rs10435844 | 0.51 | 0.348238045 | 0.6467 |
| hCV25751916 | rs10985070 | hCV11266268 | rs10760121 | 0.51 | 0.348238045 | 0.6691 |
| hCV25751916 | rs10985070 | hCV11720351 | rs1885995 | 0.51 | 0.348238045 | 0.4963 |
| hCV25751916 | rs10985070 | hCV11720413 | rs1930782 | 0.51 | 0.348238045 | 0.9671 |
| hCV25751916 | rs10985070 | hCV11720414 | rs1930781 | 0.51 | 0.348238045 | 0.6467 |
| hCV25751916 | rs10985070 | hCV1452630 | rs10818476 | 0.51 | 0.348238045 | 0.3756 |
| hCV25751916 | rs10985070 | hCV1452651 | rs3793638 | 0.51 | 0.348238045 | 0.3542 |
| hCV25751916 | rs10985070 | hCV1452652 | rs1060817 | 0.51 | 0.348238045 | 0.3542 |
| hCV25751916 | rs10985070 | hCV1452665 | rs4837796 | 0.51 | 0.348238045 | 0.3756 |
| hCV25751916 | rs10985070 | hCV15751717 | rs2296077 | 0.51 | 0.348238045 | 0.4374 |
| hCV25751916 | rs10985070 | hCV15751719 | rs2146838 | 0.51 | 0.348238045 | 0.4963 |
| hCV25751916 | rs10985070 | hCV15757738 | rs2302498 | 0.51 | 0.348238045 | 0.4505 |
| hCV25751916 | rs10985070 | hCV15849116 | rs2900180 | 0.51 | 0.348238045 | 0.6342 |
| hCV25751916 | rs10985070 | hCV15870898 | rs2072438 | 0.51 | 0.348238045 | 1 |
| hCV25751916 | rs10985070 | hCV16124825 | rs2109895 | 0.51 | 0.348238045 | 0.6467 |
| hCV25751916 | rs10985070 | hCV16175379 | rs2239657 | 0.51 | 0.348238045 | 0.625 |
| hCV25751916 | rs10985070 | hCV16234795 | rs2416804 | 0.51 | 0.348238045 | 0.9353 |
| hCV25751916 | rs10985070 | hCV1761881 | rs3933326 | 0.51 | 0.348238045 | 0.3563 |
| hCV25751916 | rs10985070 | hCV1761888 | rs1953126 | 0.51 | 0.348238045 | 0.6691 |
| hCV25751916 | rs10985070 | hCV1761891 | rs1930778 | 0.51 | 0.348238045 | 0.6222 |
| hCV25751916 | rs10985070 | hCV1761894 | rs1609810 | 0.51 | 0.348238045 | 0.6485 |
| hCV25751916 | rs10985070 | hCV22272588 | rs10760117 | 0.51 | 0.348238045 | 0.3756 |
| hCV25751916 | rs10985070 | hCV2359565 | rs1014530 | 0.51 | 0.348238045 | 0.9671 |
| hCV25751916 | rs10985070 | hCV26144307 | rs1016468 | 0.51 | 0.348238045 | 0.4963 |
| hCV25751916 | rs10985070 | hCV26144332 | rs4837813 | 0.51 | 0.348238045 | 0.4761 |
| hCV25751916 | rs10985070 | hCV2783582 | rs10818482 | 0.51 | 0.348238045 | 1 |
| hCV25751916 | rs10985070 | hCV2783586 | rs2270231 | 0.51 | 0.348238045 | 0.6691 |
| hCV25751916 | rs10985070 | hCV2783589 | rs881375 | 0.51 | 0.348238045 | 0.6691 |
| hCV25751916 | rs10985070 | hCV2783590 | rs6478486 | 0.51 | 0.348238045 | 0.6691 |
| hCV25751916 | rs10985070 | hCV2783591 | rs1468671 | 0.51 | 0.348238045 | 0.6467 |
| hCV25751916 | rs10985070 | hCV2783593 | rs1548783 | 0.51 | 0.348238045 | 0.6423 |
| hCV25751916 | rs10985070 | hCV2783597 | rs1860824 | 0.51 | 0.348238045 | 0.6357 |
| hCV25751916 | rs10985070 | hCV2783599 | rs7046108 | 0.51 | 0.348238045 | 0.6467 |
| hCV25751916 | rs10985070 | hCV2783604 | rs10760126 | 0.51 | 0.348238045 | 0.9666 |
| hCV25751916 | rs10985070 | hCV2783607 | rs9886724 | 0.51 | 0.348238045 | 1 |
| hCV25751916 | rs10985070 | hCV2783608 | rs4836834 | 0.51 | 0.348238045 | 0.9671 |
| hCV25751916 | rs10985070 | hCV2783609 | rs2241003 | 0.51 | 0.348238045 | 0.7074 |
| hCV25751916 | rs10985070 | hCV2783611 | rs10435843 | 0.51 | 0.348238045 | 0.6467 |
| hCV25751916 | rs10985070 | hCV2783618 | rs2239658 | 0.51 | 0.348238045 | 0.6467 |
| hCV25751916 | rs10985070 | hCV2783620 | rs7021880 | 0.51 | 0.348238045 | 0.5878 |
| hCV25751916 | rs10985070 | hCV2783621 | rs2416805 | 0.51 | 0.348238045 | 0.6467 |
| hCV25751916 | rs10985070 | hCV2783622 | rs758959 | 0.51 | 0.348238045 | 0.6467 |
| hCV25751916 | rs10985070 | hCV2783625 | rs10118357 | 0.51 | 0.348238045 | 0.9665 |
| hCV25751916 | rs10985070 | hCV2783630 | rs2269060 | 0.51 | 0.348238045 | 0.9671 |
| hCV25751916 | rs10985070 | hCV2783633 | rs7021049 | 0.51 | 0.348238045 | 0.9671 |
| hCV25751916 | rs10985070 | hCV2783634 | rs1014529 | 0.51 | 0.348238045 | 0.6467 |
| hCV25751916 | rs10985070 | hCV2783635 | rs1930780 | 0.51 | 0.348238045 | 0.6467 |
| hCV25751916 | rs10985070 | hCV2783638 | rs3761846 | 0.51 | 0.348238045 | 0.9671 |
| hCV25751916 | rs10985070 | hCV2783640 | rs3761847 | 0.51 | 0.348238045 | 0.9353 |
| hCV25751916 | rs10985070 | hCV2783641 | rs2416806 | 0.51 | 0.348238045 | 0.6594 |
| hCV25751916 | rs10985070 | hCV2783647 | rs10739580 | 0.51 | 0.348238045 | 0.6467 |
| hCV25751916 | rs10985070 | hCV2783650 | rs10760129 | 0.51 | 0.348238045 | 0.9671 |
| hCV25751916 | rs10985070 | hCV2783653 | rs10760130 | 0.51 | 0.348238045 | 0.9671 |
| hCV25751916 | rs10985070 | hCV2783655 | rs10818488 | 0.51 | 0.348238045 | 0.9671 |

TABLE 4-continued

| Interrogated SNP | Interrogated rs | LD SNP | LD SNP rs | Power | Threshold r² | r² |
|---|---|---|---|---|---|---|
| hCV25751916 | rs10985070 | hCV2783656 | rs4837804 | 0.51 | 0.348238045 | 0.7472 |
| hCV25751916 | rs10985070 | hCV2783659 | rs7039505 | 0.51 | 0.348238045 | 0.6319 |
| hCV25751916 | rs10985070 | hCV2783711 | rs10733650 | 0.51 | 0.348238045 | 0.3903 |
| hCV25751916 | rs10985070 | hCV2783718 | rs10818500 | 0.51 | 0.348238045 | 0.6972 |
| hCV25751916 | rs10985070 | hCV29005955 | rs7036980 | 0.51 | 0.348238045 | 0.4304 |
| hCV25751916 | rs10985070 | hCV29005976 | rs7037195 | 0.51 | 0.348238045 | 0.9671 |
| hCV25751916 | rs10985070 | hCV29005978 | rs7021206 | 0.51 | 0.348238045 | 0.6788 |
| hCV25751916 | rs10985070 | hCV29006006 | rs7034390 | 0.51 | 0.348238045 | 0.6691 |
| hCV25751916 | rs10985070 | hCV29879049 | rs9792437 | 0.51 | 0.348238045 | 0.4711 |
| hCV25751916 | rs10985070 | hCV3045812 | rs7030849 | 0.51 | 0.348238045 | 0.4711 |
| hCV25751916 | rs10985070 | hCV30829523 | rs12343516 | 0.51 | 0.348238045 | 0.3542 |
| hCV25751916 | rs10985070 | hCV30830319 | rs7037673 | 0.51 | 0.348238045 | 0.5359 |
| hCV25751916 | rs10985070 | hCV30830325 | rs10818494 | 0.51 | 0.348238045 | 0.4346 |
| hCV25751916 | rs10985070 | hCV30830340 | rs10760134 | 0.51 | 0.348238045 | 0.4135 |
| hCV25751916 | rs10985070 | hCV30830341 | rs7040033 | 0.51 | 0.348238045 | 0.4135 |
| hCV25751916 | rs10985070 | hCV30830419 | rs10985140 | 0.51 | 0.348238045 | 0.6598 |
| hCV25751916 | rs10985070 | hCV30830474 | rs10739590 | 0.51 | 0.348238045 | 0.5521 |
| hCV25751916 | rs10985070 | hCV30830638 | rs10985073 | 0.51 | 0.348238045 | 1 |
| hCV25751916 | rs10985070 | hCV30830725 | rs7864019 | 0.51 | 0.348238045 | 0.6467 |
| hCV25751916 | rs10985070 | hCV30830832 | rs10733648 | 0.51 | 0.348238045 | 0.6467 |
| hCV25751916 | rs10985070 | hCV30830909 | rs11794516 | 0.51 | 0.348238045 | 1 |
| hCV25751916 | rs10985070 | hCV7577254 | rs942152 | 0.51 | 0.348238045 | 0.4017 |
| hCV25751916 | rs10985070 | hCV7577317 | rs1323472 | 0.51 | 0.348238045 | 0.6896 |
| hCV25751916 | rs10985070 | hCV7577331 | rs1468673 | 0.51 | 0.348238045 | 0.6896 |
| hCV25751916 | rs10985070 | hCV7577344 | rs876445 | 0.51 | 0.348238045 | 0.6467 |
| hCV25751916 | rs10985070 | hCV782875 | rs746182 | 0.51 | 0.348238045 | 0.4761 |
| hCV25763321 | rs3747841 | hCV15755667 | rs2300931 | 0.51 | 0.90039199 | 1 |
| hCV25763321 | rs3747841 | hCV15875956 | rs2269065 | 0.51 | 0.90039199 | 1 |
| hCV25763321 | rs3747841 | hCV15875964 | rs2269063 | 0.51 | 0.90039199 | 1 |
| hCV25763321 | rs3747841 | hCV16175378 | rs2239656 | 0.51 | 0.90039199 | 1 |
| hCV25763321 | rs3747841 | hCV16186951 | rs2297574 | 0.51 | 0.90039199 | 1 |
| hCV25763321 | rs3747841 | hCV25613570 | rs12237774 | 0.51 | 0.90039199 | 1 |
| hCV25763321 | rs3747841 | hCV25965958 | rs10985153 | 0.51 | 0.90039199 | 1 |
| hCV25763321 | rs3747841 | hCV2783663 | rs10760131 | 0.51 | 0.90039199 | 1 |
| hCV25763321 | rs3747841 | hCV29005991 | rs7863127 | 0.51 | 0.90039199 | 1 |
| hCV25763321 | rs3747841 | hCV29005993 | rs6478491 | 0.51 | 0.90039199 | 1 |
| hCV25763321 | rs3747841 | hCV30830577 | rs6478488 | 0.51 | 0.90039199 | 1 |
| hCV25763321 | rs3747841 | hCV30830801 | rs10985095 | 0.51 | 0.90039199 | 1 |
| hCV25763321 | rs3747841 | hCV30830870 | rs7027145 | 0.51 | 0.90039199 | 1 |
| hCV25763321 | rs3747841 | hCV30830887 | rs10985097 | 0.51 | 0.90039199 | 1 |
| hCV25763321 | rs3747841 | hCV30830913 | rs10818489 | 0.51 | 0.90039199 | 1 |
| hCV25763321 | rs3747841 | hCV30830915 | rs10985105 | 0.51 | 0.90039199 | 1 |
| hCV25763321 | rs3747841 | hCV30830938 | rs12235400 | 0.51 | 0.90039199 | 1 |
| hCV2783582 | rs10818482 | hCV11266229 | rs10435844 | 0.51 | 0.33772028 | 0.6467 |
| hCV2783582 | rs10818482 | hCV11266268 | rs10760121 | 0.51 | 0.33772028 | 0.6691 |
| hCV2783582 | rs10818482 | hCV11720351 | rs1885995 | 0.51 | 0.33772028 | 0.4963 |
| hCV2783582 | rs10818482 | hCV11720402 | rs17611 | 0.51 | 0.33772028 | 0.347 |
| hCV2783582 | rs10818482 | hCV11720413 | rs1930782 | 0.51 | 0.33772028 | 0.9671 |
| hCV2783582 | rs10818482 | hCV11720414 | rs1930781 | 0.51 | 0.33772028 | 0.6467 |
| hCV2783582 | rs10818482 | hCV1452630 | rs10818476 | 0.51 | 0.33772028 | 0.3756 |
| hCV2783582 | rs10818482 | hCV1452651 | rs3793638 | 0.51 | 0.33772028 | 0.3542 |
| hCV2783582 | rs10818482 | hCV1452652 | rs1060817 | 0.51 | 0.33772028 | 0.3542 |
| hCV2783582 | rs10818482 | hCV1452665 | rs4837796 | 0.51 | 0.33772028 | 0.3756 |
| hCV2783582 | rs10818482 | hCV15751717 | rs2296077 | 0.51 | 0.33772028 | 0.4374 |
| hCV2783582 | rs10818482 | hCV15751719 | rs2146838 | 0.51 | 0.33772028 | 0.4963 |
| hCV2783582 | rs10818482 | hCV15757738 | rs2302498 | 0.51 | 0.33772028 | 0.4505 |
| hCV2783582 | rs10818482 | hCV15849116 | rs2900180 | 0.51 | 0.33772028 | 0.6342 |
| hCV2783582 | rs10818482 | hCV15870898 | rs2072438 | 0.51 | 0.33772028 | 1 |
| hCV2783582 | rs10818482 | hCV16124825 | rs2109895 | 0.51 | 0.33772028 | 0.6467 |
| hCV2783582 | rs10818482 | hCV16175379 | rs2239657 | 0.51 | 0.33772028 | 0.625 |
| hCV2783582 | rs10818482 | hCV16234785 | rs2416811 | 0.51 | 0.33772028 | 0.347 |
| hCV2783582 | rs10818482 | hCV16234795 | rs2416804 | 0.51 | 0.33772028 | 0.9353 |
| hCV2783582 | rs10818482 | hCV1761881 | rs3933326 | 0.51 | 0.33772028 | 0.3563 |
| hCV2783582 | rs10818482 | hCV1761888 | rs1953126 | 0.51 | 0.33772028 | 0.6691 |
| hCV2783582 | rs10818482 | hCV1761891 | rs1930778 | 0.51 | 0.33772028 | 0.6222 |
| hCV2783582 | rs10818482 | hCV1761894 | rs1609810 | 0.51 | 0.33772028 | 0.6485 |
| hCV2783582 | rs10818482 | hCV22272588 | rs10760117 | 0.51 | 0.33772028 | 0.3756 |
| hCV2783582 | rs10818482 | hCV2359565 | rs1014530 | 0.51 | 0.33772028 | 0.9671 |
| hCV2783582 | rs10818482 | hCV2359571 | rs25681 | 0.51 | 0.33772028 | 0.347 |
| hCV2783582 | rs10818482 | hCV25751916 | rs10985070 | 0.51 | 0.33772028 | 1 |
| hCV2783582 | rs10818482 | hCV25757804 | rs4836833 | 0.51 | 0.33772028 | 0.3396 |
| hCV2783582 | rs10818482 | hCV26144282 | rs10818499 | 0.51 | 0.33772028 | 0.347 |
| hCV2783582 | rs10818482 | hCV26144291 | rs4570235 | 0.51 | 0.33772028 | 0.347 |
| hCV2783582 | rs10818482 | hCV26144307 | rs1016468 | 0.51 | 0.33772028 | 0.4963 |
| hCV2783582 | rs10818482 | hCV26144332 | rs4837813 | 0.51 | 0.33772028 | 0.4761 |
| hCV2783582 | rs10818482 | hCV2783586 | rs2270231 | 0.51 | 0.33772028 | 0.6691 |
| hCV2783582 | rs10818482 | hCV2783589 | rs881375 | 0.51 | 0.33772028 | 0.6691 |

TABLE 4-continued

| Interrogated SNP | Interrogated rs | LD SNP | LD SNP rs | Power | Threshold r² | r² |
|---|---|---|---|---|---|---|
| hCV2783582 | rs10818482 | hCV2783590 | rs6478486 | 0.51 | 0.33772028 | 0.6691 |
| hCV2783582 | rs10818482 | hCV2783591 | rs1468671 | 0.51 | 0.33772028 | 0.6467 |
| hCV2783582 | rs10818482 | hCV2783593 | rs1548783 | 0.51 | 0.33772028 | 0.6423 |
| hCV2783582 | rs10818482 | hCV2783597 | rs1860824 | 0.51 | 0.33772028 | 0.6357 |
| hCV2783582 | rs10818482 | hCV2783599 | rs7046108 | 0.51 | 0.33772028 | 0.6467 |
| hCV2783582 | rs10818482 | hCV2783604 | rs10760126 | 0.51 | 0.33772028 | 0.9666 |
| hCV2783582 | rs10818482 | hCV2783607 | rs9886724 | 0.51 | 0.33772028 | 1 |
| hCV2783582 | rs10818482 | hCV2783608 | rs4836834 | 0.51 | 0.33772028 | 0.9671 |
| hCV2783582 | rs10818482 | hCV2783609 | rs2241003 | 0.51 | 0.33772028 | 0.7074 |
| hCV2783582 | rs10818482 | hCV2783611 | rs10435843 | 0.51 | 0.33772028 | 0.6467 |
| hCV2783582 | rs10818482 | hCV2783618 | rs2239658 | 0.51 | 0.33772028 | 0.6467 |
| hCV2783582 | rs10818482 | hCV2783620 | rs7021880 | 0.51 | 0.33772028 | 0.5878 |
| hCV2783582 | rs10818482 | hCV2783621 | rs2416805 | 0.51 | 0.33772028 | 0.6467 |
| hCV2783582 | rs10818482 | hCV2783622 | rs758959 | 0.51 | 0.33772028 | 0.6467 |
| hCV2783582 | rs10818482 | hCV2783625 | rs10118357 | 0.51 | 0.33772028 | 0.9665 |
| hCV2783582 | rs10818482 | hCV2783630 | rs2269060 | 0.51 | 0.33772028 | 0.9671 |
| hCV2783582 | rs10818482 | hCV2783633 | rs7021049 | 0.51 | 0.33772028 | 0.9671 |
| hCV2783582 | rs10818482 | hCV2783634 | rs1014529 | 0.51 | 0.33772028 | 0.6467 |
| hCV2783582 | rs10818482 | hCV2783635 | rs1930780 | 0.51 | 0.33772028 | 0.6467 |
| hCV2783582 | rs10818482 | hCV2783638 | rs3761846 | 0.51 | 0.33772028 | 0.9671 |
| hCV2783582 | rs10818482 | hCV2783640 | rs3761847 | 0.51 | 0.33772028 | 0.9353 |
| hCV2783582 | rs10818482 | hCV2783641 | rs2416806 | 0.51 | 0.33772028 | 0.6594 |
| hCV2783582 | rs10818482 | hCV2783647 | rs10739580 | 0.51 | 0.33772028 | 0.6467 |
| hCV2783582 | rs10818482 | hCV2783650 | rs10760129 | 0.51 | 0.33772028 | 0.9671 |
| hCV2783582 | rs10818482 | hCV2783653 | rs10760130 | 0.51 | 0.33772028 | 0.9671 |
| hCV2783582 | rs10818482 | hCV2783655 | rs10818488 | 0.51 | 0.33772028 | 0.9671 |
| hCV2783582 | rs10818482 | hCV2783656 | rs4837804 | 0.51 | 0.33772028 | 0.7472 |
| hCV2783582 | rs10818482 | hCV2783659 | rs7039505 | 0.51 | 0.33772028 | 0.6319 |
| hCV2783582 | rs10818482 | hCV2783711 | rs10733650 | 0.51 | 0.33772028 | 0.3903 |
| hCV2783582 | rs10818482 | hCV2783718 | rs10818500 | 0.51 | 0.33772028 | 0.6972 |
| hCV2783582 | rs10818482 | hCV29005955 | rs7036980 | 0.51 | 0.33772028 | 0.4304 |
| hCV2783582 | rs10818482 | hCV29005976 | rs7037195 | 0.51 | 0.33772028 | 0.9671 |
| hCV2783582 | rs10818482 | hCV29005978 | rs7021206 | 0.51 | 0.33772028 | 0.6788 |
| hCV2783582 | rs10818482 | hCV29006006 | rs7034390 | 0.51 | 0.33772028 | 0.6691 |
| hCV2783582 | rs10818482 | hCV29879049 | rs9792437 | 0.51 | 0.33772028 | 0.4711 |
| hCV2783582 | rs10818482 | hCV3045812 | rs7030849 | 0.51 | 0.33772028 | 0.4711 |
| hCV2783582 | rs10818482 | hCV30829523 | rs12343516 | 0.51 | 0.33772028 | 0.3542 |
| hCV2783582 | rs10818482 | hCV30830319 | rs7037673 | 0.51 | 0.33772028 | 0.5359 |
| hCV2783582 | rs10818482 | hCV30830325 | rs10818494 | 0.51 | 0.33772028 | 0.4346 |
| hCV2783582 | rs10818482 | hCV30830340 | rs10760134 | 0.51 | 0.33772028 | 0.4135 |
| hCV2783582 | rs10818482 | hCV30830341 | rs7040033 | 0.51 | 0.33772028 | 0.4135 |
| hCV2783582 | rs10818482 | hCV30830419 | rs10985140 | 0.51 | 0.33772028 | 0.6598 |
| hCV2783582 | rs10818482 | hCV30830474 | rs10739590 | 0.51 | 0.33772028 | 0.5521 |
| hCV2783582 | rs10818482 | hCV30830638 | rs10985073 | 0.51 | 0.33772028 | 1 |
| hCV2783582 | rs10818482 | hCV30830725 | rs7864019 | 0.51 | 0.33772028 | 0.6467 |
| hCV2783582 | rs10818482 | hCV30830832 | rs10733648 | 0.51 | 0.33772028 | 0.6467 |
| hCV2783582 | rs10818482 | hCV30830909 | rs11794516 | 0.51 | 0.33772028 | 1 |
| hCV2783582 | rs10818482 | hCV7577254 | rs942152 | 0.51 | 0.33772028 | 0.4017 |
| hCV2783582 | rs10818482 | hCV7577317 | rs1323472 | 0.51 | 0.33772028 | 0.6896 |
| hCV2783582 | rs10818482 | hCV7577331 | rs1468673 | 0.51 | 0.33772028 | 0.6896 |
| hCV2783582 | rs10818482 | hCV7577337 | rs993247 | 0.51 | 0.33772028 | 0.347 |
| hCV2783582 | rs10818482 | hCV7577344 | rs876445 | 0.51 | 0.33772028 | 0.6467 |
| hCV2783582 | rs10818482 | hCV782875 | rs746182 | 0.51 | 0.33772028 | 0.4761 |
| hCV2783582 | rs10818482 | hCV8780517 | rs1056567 | 0.51 | 0.33772028 | 0.3396 |
| hCV2783586 | rs2270231 | hCV11266229 | rs10435844 | 0.51 | 0.467936232 | 0.9666 |
| hCV2783586 | rs2270231 | hCV11266268 | rs10760121 | 0.51 | 0.467936232 | 1 |
| hCV2783586 | rs2270231 | hCV11720350 | rs2057469 | 0.51 | 0.467936232 | 0.4734 |
| hCV2783586 | rs2270231 | hCV11720413 | rs1930782 | 0.51 | 0.467936232 | 0.6344 |
| hCV2783586 | rs2270231 | hCV11720414 | rs1930781 | 0.51 | 0.467936232 | 0.9666 |
| hCV2783586 | rs2270231 | hCV15849105 | rs2900185 | 0.51 | 0.467936232 | 0.4989 |
| hCV2783586 | rs2270231 | hCV15849116 | rs2900180 | 0.51 | 0.467936232 | 0.9622 |
| hCV2783586 | rs2270231 | hCV15870898 | rs2072438 | 0.51 | 0.467936232 | 0.6691 |
| hCV2783586 | rs2270231 | hCV16124825 | rs2109895 | 0.51 | 0.467936232 | 0.9666 |
| hCV2783586 | rs2270231 | hCV16175379 | rs2239657 | 0.51 | 0.467936232 | 0.9341 |
| hCV2783586 | rs2270231 | hCV16234795 | rs2416804 | 0.51 | 0.467936232 | 0.6014 |
| hCV2783586 | rs2270231 | hCV16234838 | rs2416819 | 0.51 | 0.467936232 | 0.4734 |
| hCV2783586 | rs2270231 | hCV16234840 | rs2416817 | 0.51 | 0.467936232 | 0.4989 |
| hCV2783586 | rs2270231 | hCV1632195 | rs1998505 | 0.51 | 0.467936232 | 0.4989 |
| hCV2783586 | rs2270231 | hCV1761888 | rs1953126 | 0.51 | 0.467936232 | 1 |
| hCV2783586 | rs2270231 | hCV1761891 | rs1930778 | 0.51 | 0.467936232 | 1 |
| hCV2783586 | rs2270231 | hCV1761894 | rs1609810 | 0.51 | 0.467936232 | 1 |
| hCV2783586 | rs2270231 | hCV2359565 | rs1014530 | 0.51 | 0.467936232 | 0.6344 |
| hCV2783586 | rs2270231 | hCV25613469 | rs10760157 | 0.51 | 0.467936232 | 0.4734 |
| hCV2783586 | rs2270231 | hCV25751916 | rs10985070 | 0.51 | 0.467936232 | 0.6691 |
| hCV2783586 | rs2270231 | hCV25771057 | rs10760150 | 0.51 | 0.467936232 | 0.4989 |
| hCV2783586 | rs2270231 | hCV2783582 | rs10818482 | 0.51 | 0.467936232 | 0.6691 |
| hCV2783586 | rs2270231 | hCV2783589 | rs881375 | 0.51 | 0.467936232 | 1 |

TABLE 4-continued

| Interrogated SNP | Interrogated rs | LD SNP | LD SNP rs | Power | Threshold r² | r² |
|---|---|---|---|---|---|---|
| hCV2783586 | rs2270231 | hCV2783590 | rs6478486 | 0.51 | 0.467936232 | 1 |
| hCV2783586 | rs2270231 | hCV2783591 | rs1468671 | 0.51 | 0.467936232 | 0.9666 |
| hCV2783586 | rs2270231 | hCV2783593 | rs1548783 | 0.51 | 0.467936232 | 0.9661 |
| hCV2783586 | rs2270231 | hCV2783597 | rs1860824 | 0.51 | 0.467936232 | 0.965 |
| hCV2783586 | rs2270231 | hCV2783599 | rs7046108 | 0.51 | 0.467936232 | 0.9666 |
| hCV2783586 | rs2270231 | hCV2783604 | rs10760126 | 0.51 | 0.467936232 | 0.6526 |
| hCV2783586 | rs2270231 | hCV2783607 | rs9886724 | 0.51 | 0.467936232 | 0.6785 |
| hCV2783586 | rs2270231 | hCV2783608 | rs4836834 | 0.51 | 0.467936232 | 0.6344 |
| hCV2783586 | rs2270231 | hCV2783609 | rs2241003 | 0.51 | 0.467936232 | 0.9321 |
| hCV2783586 | rs2270231 | hCV2783611 | rs10435843 | 0.51 | 0.467936232 | 0.9666 |
| hCV2783586 | rs2270231 | hCV2783618 | rs2239658 | 0.51 | 0.467936232 | 0.9666 |
| hCV2783586 | rs2270231 | hCV2783620 | rs7021880 | 0.51 | 0.467936232 | 0.8974 |
| hCV2783586 | rs2270231 | hCV2783621 | rs2416805 | 0.51 | 0.467936232 | 0.9666 |
| hCV2783586 | rs2270231 | hCV2783622 | rs758959 | 0.51 | 0.467936232 | 0.9666 |
| hCV2783586 | rs2270231 | hCV2783625 | rs10118357 | 0.51 | 0.467936232 | 0.6295 |
| hCV2783586 | rs2270231 | hCV2783630 | rs2269060 | 0.51 | 0.467936232 | 0.6344 |
| hCV2783586 | rs2270231 | hCV2783633 | rs7021049 | 0.51 | 0.467936232 | 0.6344 |
| hCV2783586 | rs2270231 | hCV2783634 | rs1014529 | 0.51 | 0.467936232 | 0.9666 |
| hCV2783586 | rs2270231 | hCV2783635 | rs1930780 | 0.51 | 0.467936232 | 0.9666 |
| hCV2783586 | rs2270231 | hCV2783638 | rs3761846 | 0.51 | 0.467936232 | 0.6344 |
| hCV2783586 | rs2270231 | hCV2783640 | rs3761847 | 0.51 | 0.467936232 | 0.6014 |
| hCV2783586 | rs2270231 | hCV2783641 | rs2416806 | 0.51 | 0.467936232 | 1 |
| hCV2783586 | rs2270231 | hCV2783647 | rs10739580 | 0.51 | 0.467936232 | 0.9666 |
| hCV2783586 | rs2270231 | hCV2783650 | rs10760129 | 0.51 | 0.467936232 | 0.6344 |
| hCV2783586 | rs2270231 | hCV2783653 | rs10760130 | 0.51 | 0.467936232 | 0.6344 |
| hCV2783586 | rs2270231 | hCV2783655 | rs10818488 | 0.51 | 0.467936232 | 0.6344 |
| hCV2783586 | rs2270231 | hCV2783656 | rs4837804 | 0.51 | 0.467936232 | 0.8593 |
| hCV2783586 | rs2270231 | hCV2783659 | rs7039505 | 0.51 | 0.467936232 | 0.9615 |
| hCV2783586 | rs2270231 | hCV27912350 | rs4837808 | 0.51 | 0.467936232 | 0.4989 |
| hCV2783586 | rs2270231 | hCV27912351 | rs4837809 | 0.51 | 0.467936232 | 0.4989 |
| hCV2783586 | rs2270231 | hCV29005924 | rs7031128 | 0.51 | 0.467936232 | 0.4729 |
| hCV2783586 | rs2270231 | hCV29005976 | rs7037195 | 0.51 | 0.467936232 | 0.6344 |
| hCV2783586 | rs2270231 | hCV29005978 | rs7021206 | 0.51 | 0.467936232 | 0.9651 |
| hCV2783586 | rs2270231 | hCV29006006 | rs7034390 | 0.51 | 0.467936232 | 1 |
| hCV2783586 | rs2270231 | hCV30059070 | rs10156413 | 0.51 | 0.467936232 | 0.5621 |
| hCV2783586 | rs2270231 | hCV3045792 | rs6478499 | 0.51 | 0.467936232 | 0.5164 |
| hCV2783586 | rs2270231 | hCV30563729 | rs9299273 | 0.51 | 0.467936232 | 0.4989 |
| hCV2783586 | rs2270231 | hCV30830468 | rs10818507 | 0.51 | 0.467936232 | 0.4819 |
| hCV2783586 | rs2270231 | hCV30830473 | rs7036649 | 0.51 | 0.467936232 | 0.5014 |
| hCV2783586 | rs2270231 | hCV30830484 | rs10818508 | 0.51 | 0.467936232 | 0.4989 |
| hCV2783586 | rs2270231 | hCV30830486 | rs10760149 | 0.51 | 0.467936232 | 0.4989 |
| hCV2783586 | rs2270231 | hCV30830503 | rs4837811 | 0.51 | 0.467936232 | 0.4989 |
| hCV2783586 | rs2270231 | hCV30830512 | rs10818512 | 0.51 | 0.467936232 | 0.4734 |
| hCV2783586 | rs2270231 | hCV30830521 | rs10818513 | 0.51 | 0.467936232 | 0.4734 |
| hCV2783586 | rs2270231 | hCV30830536 | rs7047038 | 0.51 | 0.467936232 | 0.4734 |
| hCV2783586 | rs2270231 | hCV30830638 | rs10985073 | 0.51 | 0.467936232 | 0.6691 |
| hCV2783586 | rs2270231 | hCV30830725 | rs7864019 | 0.51 | 0.467936232 | 0.9666 |
| hCV2783586 | rs2270231 | hCV30830832 | rs10733648 | 0.51 | 0.467936232 | 0.9666 |
| hCV2783586 | rs2270231 | hCV30830909 | rs11794516 | 0.51 | 0.467936232 | 0.6691 |
| hCV2783586 | rs2270231 | hCV7577250 | rs942153 | 0.51 | 0.467936232 | 0.4734 |
| hCV2783586 | rs2270231 | hCV7577271 | rs1535655 | 0.51 | 0.467936232 | 0.4734 |
| hCV2783586 | rs2270231 | hCV7577287 | rs1323478 | 0.51 | 0.467936232 | 0.4989 |
| hCV2783586 | rs2270231 | hCV7577296 | rs1407910 | 0.51 | 0.467936232 | 0.4989 |
| hCV2783586 | rs2270231 | hCV7577344 | rs876445 | 0.51 | 0.467936232 | 0.9666 |
| hCV2783589 | rs881375 | hCV11266229 | rs10435844 | 0.51 | 0.499966299 | 0.9666 |
| hCV2783589 | rs881375 | hCV11266268 | rs10760121 | 0.51 | 0.499966299 | 1 |
| hCV2783589 | rs881375 | hCV11720413 | rs1930782 | 0.51 | 0.499966299 | 0.6344 |
| hCV2783589 | rs881375 | hCV11720414 | rs1930781 | 0.51 | 0.499966299 | 0.9666 |
| hCV2783589 | rs881375 | hCV15849116 | rs2900180 | 0.51 | 0.499966299 | 0.9622 |
| hCV2783589 | rs881375 | hCV15870898 | rs2072438 | 0.51 | 0.499966299 | 0.6691 |
| hCV2783589 | rs881375 | hCV16124825 | rs2109895 | 0.51 | 0.499966299 | 0.9666 |
| hCV2783589 | rs881375 | hCV16175379 | rs2239657 | 0.51 | 0.499966299 | 0.9341 |
| hCV2783589 | rs881375 | hCV16234795 | rs2416804 | 0.51 | 0.499966299 | 0.6014 |
| hCV2783589 | rs881375 | hCV1761888 | rs1953126 | 0.51 | 0.499966299 | 1 |
| hCV2783589 | rs881375 | hCV1761891 | rs1930778 | 0.51 | 0.499966299 | 1 |
| hCV2783589 | rs881375 | hCV1761894 | rs1609810 | 0.51 | 0.499966299 | 1 |
| hCV2783589 | rs881375 | hCV2359565 | rs1014530 | 0.51 | 0.499966299 | 0.6344 |
| hCV2783589 | rs881375 | hCV25751916 | rs10985070 | 0.51 | 0.499966299 | 0.6691 |
| hCV2783589 | rs881375 | hCV2783582 | rs10818482 | 0.51 | 0.499966299 | 0.6691 |
| hCV2783589 | rs881375 | hCV2783586 | rs2270231 | 0.51 | 0.499966299 | 1 |
| hCV2783589 | rs881375 | hCV2783590 | rs6478486 | 0.51 | 0.499966299 | 1 |
| hCV2783589 | rs881375 | hCV2783591 | rs1468671 | 0.51 | 0.499966299 | 0.9666 |
| hCV2783589 | rs881375 | hCV2783593 | rs1548783 | 0.51 | 0.499966299 | 0.9661 |
| hCV2783589 | rs881375 | hCV2783597 | rs1860824 | 0.51 | 0.499966299 | 0.965 |
| hCV2783589 | rs881375 | hCV2783599 | rs7046108 | 0.51 | 0.499966299 | 0.9666 |
| hCV2783589 | rs881375 | hCV2783604 | rs10760126 | 0.51 | 0.499966299 | 0.6526 |
| hCV2783589 | rs881375 | hCV2783607 | rs9886724 | 0.51 | 0.499966299 | 0.6785 |

TABLE 4-continued

| Interrogated SNP | Interrogated rs | LD SNP | LD SNP rs | Power | Threshold r² | r² |
|---|---|---|---|---|---|---|
| hCV2783589 | rs881375 | hCV2783608 | rs4836834 | 0.51 | 0.499966299 | 0.6344 |
| hCV2783589 | rs881375 | hCV2783609 | rs2241003 | 0.51 | 0.499966299 | 0.9321 |
| hCV2783589 | rs881375 | hCV2783611 | rs10435843 | 0.51 | 0.499966299 | 0.9666 |
| hCV2783589 | rs881375 | hCV2783618 | rs2239658 | 0.51 | 0.499966299 | 0.9666 |
| hCV2783589 | rs881375 | hCV2783620 | rs7021880 | 0.51 | 0.499966299 | 0.8974 |
| hCV2783589 | rs881375 | hCV2783621 | rs2416805 | 0.51 | 0.499966299 | 0.9666 |
| hCV2783589 | rs881375 | hCV2783622 | rs758959 | 0.51 | 0.499966299 | 0.9666 |
| hCV2783589 | rs881375 | hCV2783625 | rs10118357 | 0.51 | 0.499966299 | 0.6295 |
| hCV2783589 | rs881375 | hCV2783630 | rs2269060 | 0.51 | 0.499966299 | 0.6344 |
| hCV2783589 | rs881375 | hCV2783633 | rs7021049 | 0.51 | 0.499966299 | 0.6344 |
| hCV2783589 | rs881375 | hCV2783634 | rs1014529 | 0.51 | 0.499966299 | 0.9666 |
| hCV2783589 | rs881375 | hCV2783635 | rs1930780 | 0.51 | 0.499966299 | 0.9666 |
| hCV2783589 | rs881375 | hCV2783638 | rs3761846 | 0.51 | 0.499966299 | 0.6344 |
| hCV2783589 | rs881375 | hCV2783640 | rs3761847 | 0.51 | 0.499966299 | 0.6014 |
| hCV2783589 | rs881375 | hCV2783641 | rs2416806 | 0.51 | 0.499966299 | 1 |
| hCV2783589 | rs881375 | hCV2783647 | rs10739580 | 0.51 | 0.499966299 | 0.9666 |
| hCV2783589 | rs881375 | hCV2783650 | rs10760129 | 0.51 | 0.499966299 | 0.6344 |
| hCV2783589 | rs881375 | hCV2783653 | rs10760130 | 0.51 | 0.499966299 | 0.6344 |
| hCV2783589 | rs881375 | hCV2783655 | rs10818488 | 0.51 | 0.499966299 | 0.6344 |
| hCV2783589 | rs881375 | hCV2783656 | rs4837804 | 0.51 | 0.499966299 | 0.8593 |
| hCV2783589 | rs881375 | hCV2783659 | rs7039505 | 0.51 | 0.499966299 | 0.9615 |
| hCV2783589 | rs881375 | hCV29005976 | rs7037195 | 0.51 | 0.499966299 | 0.6344 |
| hCV2783589 | rs881375 | hCV29005978 | rs7021206 | 0.51 | 0.499966299 | 0.9651 |
| hCV2783589 | rs881375 | hCV29006006 | rs7034390 | 0.51 | 0.499966299 | 1 |
| hCV2783589 | rs881375 | hCV30059070 | rs10156413 | 0.51 | 0.499966299 | 0.5621 |
| hCV2783589 | rs881375 | hCV3045792 | rs6478499 | 0.51 | 0.499966299 | 0.5164 |
| hCV2783589 | rs881375 | hCV30830473 | rs7036649 | 0.51 | 0.499966299 | 0.5014 |
| hCV2783589 | rs881375 | hCV30830638 | rs10985073 | 0.51 | 0.499966299 | 0.6691 |
| hCV2783589 | rs881375 | hCV30830725 | rs7864019 | 0.51 | 0.499966299 | 0.9666 |
| hCV2783589 | rs881375 | hCV30830832 | rs10733648 | 0.51 | 0.499966299 | 0.9666 |
| hCV2783589 | rs881375 | hCV30830909 | rs11794516 | 0.51 | 0.499966299 | 0.6691 |
| hCV2783589 | rs881375 | hCV7577344 | rs876445 | 0.51 | 0.499966299 | 0.9666 |
| hCV2783590 | rs6478486 | hCV11266229 | rs10435844 | 0.51 | 0.400501157 | 0.9666 |
| hCV2783590 | rs6478486 | hCV11266268 | rs10760121 | 0.51 | 0.400501157 | 1 |
| hCV2783590 | rs6478486 | hCV11720350 | rs2057469 | 0.51 | 0.400501157 | 0.4734 |
| hCV2783590 | rs6478486 | hCV11720386 | rs1998506 | 0.51 | 0.400501157 | 0.4237 |
| hCV2783590 | rs6478486 | hCV11720394 | rs1924081 | 0.51 | 0.400501157 | 0.4414 |
| hCV2783590 | rs6478486 | hCV11720413 | rs1930782 | 0.51 | 0.400501157 | 0.6344 |
| hCV2783590 | rs6478486 | hCV11720414 | rs1930781 | 0.51 | 0.400501157 | 0.9666 |
| hCV2783590 | rs6478486 | hCV15849105 | rs2900185 | 0.51 | 0.400501157 | 0.4989 |
| hCV2783590 | rs6478486 | hCV15849116 | rs2900180 | 0.51 | 0.400501157 | 0.9622 |
| hCV2783590 | rs6478486 | hCV15870898 | rs2072438 | 0.51 | 0.400501157 | 0.6691 |
| hCV2783590 | rs6478486 | hCV16124825 | rs2109895 | 0.51 | 0.400501157 | 0.9666 |
| hCV2783590 | rs6478486 | hCV16175379 | rs2239657 | 0.51 | 0.400501157 | 0.9341 |
| hCV2783590 | rs6478486 | hCV16180474 | rs2273988 | 0.51 | 0.400501157 | 0.4011 |
| hCV2783590 | rs6478486 | hCV16234795 | rs2416804 | 0.51 | 0.400501157 | 0.6014 |
| hCV2783590 | rs6478486 | hCV16234838 | rs2416819 | 0.51 | 0.400501157 | 0.4734 |
| hCV2783590 | rs6478486 | hCV16234840 | rs2416817 | 0.51 | 0.400501157 | 0.4989 |
| hCV2783590 | rs6478486 | hCV1632195 | rs1998505 | 0.51 | 0.400501157 | 0.4989 |
| hCV2783590 | rs6478486 | hCV1632205 | rs10818509 | 0.51 | 0.400501157 | 0.4237 |
| hCV2783590 | rs6478486 | hCV1761888 | rs1953126 | 0.51 | 0.400501157 | 1 |
| hCV2783590 | rs6478486 | hCV1761891 | rs1930778 | 0.51 | 0.400501157 | 1 |
| hCV2783590 | rs6478486 | hCV1761894 | rs1609810 | 0.51 | 0.400501157 | 1 |
| hCV2783590 | rs6478486 | hCV2359565 | rs1014530 | 0.51 | 0.400501157 | 0.6344 |
| hCV2783590 | rs6478486 | hCV25472748 | rs10760138 | 0.51 | 0.400501157 | 0.4328 |
| hCV2783590 | rs6478486 | hCV25613469 | rs10760157 | 0.51 | 0.400501157 | 0.4734 |
| hCV2783590 | rs6478486 | hCV25746749 | rs7023214 | 0.51 | 0.400501157 | 0.4237 |
| hCV2783590 | rs6478486 | hCV25751916 | rs10985070 | 0.51 | 0.400501157 | 0.6691 |
| hCV2783590 | rs6478486 | hCV25771057 | rs10760150 | 0.51 | 0.400501157 | 0.4989 |
| hCV2783590 | rs6478486 | hCV25969661 | rs10818503 | 0.51 | 0.400501157 | 0.4237 |
| hCV2783590 | rs6478486 | hCV26144328 | rs4836841 | 0.51 | 0.400501157 | 0.4011 |
| hCV2783590 | rs6478486 | hCV2783582 | rs10818482 | 0.51 | 0.400501157 | 0.6691 |
| hCV2783590 | rs6478486 | hCV2783586 | rs2270231 | 0.51 | 0.400501157 | 1 |
| hCV2783590 | rs6478486 | hCV2783589 | rs881375 | 0.51 | 0.400501157 | 1 |
| hCV2783590 | rs6478486 | hCV2783591 | rs1468671 | 0.51 | 0.400501157 | 0.9666 |
| hCV2783590 | rs6478486 | hCV2783593 | rs1548783 | 0.51 | 0.400501157 | 0.9661 |
| hCV2783590 | rs6478486 | hCV2783597 | rs1860824 | 0.51 | 0.400501157 | 0.965 |
| hCV2783590 | rs6478486 | hCV2783599 | rs7046108 | 0.51 | 0.400501157 | 0.9666 |
| hCV2783590 | rs6478486 | hCV2783604 | rs10760126 | 0.51 | 0.400501157 | 0.6526 |
| hCV2783590 | rs6478486 | hCV2783607 | rs9886724 | 0.51 | 0.400501157 | 0.6785 |
| hCV2783590 | rs6478486 | hCV2783608 | rs4836834 | 0.51 | 0.400501157 | 0.6344 |
| hCV2783590 | rs6478486 | hCV2783609 | rs2241003 | 0.51 | 0.400501157 | 0.9321 |
| hCV2783590 | rs6478486 | hCV2783611 | rs10435843 | 0.51 | 0.400501157 | 0.9666 |
| hCV2783590 | rs6478486 | hCV2783618 | rs2239658 | 0.51 | 0.400501157 | 0.9666 |
| hCV2783590 | rs6478486 | hCV2783620 | rs7021880 | 0.51 | 0.400501157 | 0.8974 |
| hCV2783590 | rs6478486 | hCV2783621 | rs2416805 | 0.51 | 0.400501157 | 0.9666 |
| hCV2783590 | rs6478486 | hCV2783622 | rs758959 | 0.51 | 0.400501157 | 0.9666 |

TABLE 4-continued

| Interrogated SNP | Interrogated rs | LD SNP | LD SNP rs | Power | Threshold r² | r² |
|---|---|---|---|---|---|---|
| hCV2783590 | rs6478486 | hCV2783625 | rs10118357 | 0.51 | 0.400501157 | 0.6295 |
| hCV2783590 | rs6478486 | hCV2783630 | rs2269060 | 0.51 | 0.400501157 | 0.6344 |
| hCV2783590 | rs6478486 | hCV2783633 | rs7021049 | 0.51 | 0.400501157 | 0.6344 |
| hCV2783590 | rs6478486 | hCV2783634 | rs1014529 | 0.51 | 0.400501157 | 0.9666 |
| hCV2783590 | rs6478486 | hCV2783635 | rs1930780 | 0.51 | 0.400501157 | 0.9666 |
| hCV2783590 | rs6478486 | hCV2783638 | rs3761846 | 0.51 | 0.400501157 | 0.6344 |
| hCV2783590 | rs6478486 | hCV2783640 | rs3761847 | 0.51 | 0.400501157 | 0.6014 |
| hCV2783590 | rs6478486 | hCV2783641 | rs2416806 | 0.51 | 0.400501157 | 1 |
| hCV2783590 | rs6478486 | hCV2783647 | rs10739580 | 0.51 | 0.400501157 | 0.9666 |
| hCV2783590 | rs6478486 | hCV2783650 | rs10760129 | 0.51 | 0.400501157 | 0.6344 |
| hCV2783590 | rs6478486 | hCV2783653 | rs10760130 | 0.51 | 0.400501157 | 0.6344 |
| hCV2783590 | rs6478486 | hCV2783655 | rs10818488 | 0.51 | 0.400501157 | 0.6344 |
| hCV2783590 | rs6478486 | hCV2783656 | rs4837804 | 0.51 | 0.400501157 | 0.8593 |
| hCV2783590 | rs6478486 | hCV2783659 | rs7039505 | 0.51 | 0.400501157 | 0.9615 |
| hCV2783590 | rs6478486 | hCV27912350 | rs4837808 | 0.51 | 0.400501157 | 0.4989 |
| hCV2783590 | rs6478486 | hCV27912351 | rs4837809 | 0.51 | 0.400501157 | 0.4989 |
| hCV2783590 | rs6478486 | hCV29005922 | rs7033790 | 0.51 | 0.400501157 | 0.4414 |
| hCV2783590 | rs6478486 | hCV29005923 | rs6478494 | 0.51 | 0.400501157 | 0.4648 |
| hCV2783590 | rs6478486 | hCV29005924 | rs7031128 | 0.51 | 0.400501157 | 0.4729 |
| hCV2783590 | rs6478486 | hCV29005931 | rs6478496 | 0.51 | 0.400501157 | 0.4414 |
| hCV2783590 | rs6478486 | hCV29005938 | rs7856420 | 0.51 | 0.400501157 | 0.4237 |
| hCV2783590 | rs6478486 | hCV29005976 | rs7037195 | 0.51 | 0.400501157 | 0.6344 |
| hCV2783590 | rs6478486 | hCV29005978 | rs7021206 | 0.51 | 0.400501157 | 0.9651 |
| hCV2783590 | rs6478486 | hCV29006006 | rs7034390 | 0.51 | 0.400501157 | 1 |
| hCV2783590 | rs6478486 | hCV30059070 | rs10156413 | 0.51 | 0.400501157 | 0.5621 |
| hCV2783590 | rs6478486 | hCV30293181 | rs10081760 | 0.51 | 0.400501157 | 0.4218 |
| hCV2783590 | rs6478486 | hCV3045792 | rs6478499 | 0.51 | 0.400501157 | 0.5164 |
| hCV2783590 | rs6478486 | hCV3045801 | rs2057465 | 0.51 | 0.400501157 | 0.4611 |
| hCV2783590 | rs6478486 | hCV3045802 | rs2057466 | 0.51 | 0.400501157 | 0.4011 |
| hCV2783590 | rs6478486 | hCV3045803 | rs2146836 | 0.51 | 0.400501157 | 0.4011 |
| hCV2783590 | rs6478486 | hCV30527383 | rs9644911 | 0.51 | 0.400501157 | 0.4218 |
| hCV2783590 | rs6478486 | hCV30563728 | rs10156396 | 0.51 | 0.400501157 | 0.429 |
| hCV2783590 | rs6478486 | hCV30563729 | rs9299273 | 0.51 | 0.400501157 | 0.4989 |
| hCV2783590 | rs6478486 | hCV30830342 | rs7040319 | 0.51 | 0.400501157 | 0.4044 |
| hCV2783590 | rs6478486 | hCV30830395 | rs10985132 | 0.51 | 0.400501157 | 0.4414 |
| hCV2783590 | rs6478486 | hCV30830397 | rs10760139 | 0.51 | 0.400501157 | 0.4414 |
| hCV2783590 | rs6478486 | hCV30830406 | rs7040603 | 0.51 | 0.400501157 | 0.4414 |
| hCV2783590 | rs6478486 | hCV30830407 | rs10739585 | 0.51 | 0.400501157 | 0.4414 |
| hCV2783590 | rs6478486 | hCV30830414 | rs7871371 | 0.51 | 0.400501157 | 0.4541 |
| hCV2783590 | rs6478486 | hCV30830417 | rs7029523 | 0.51 | 0.400501157 | 0.4414 |
| hCV2783590 | rs6478486 | hCV30830435 | rs10739586 | 0.51 | 0.400501157 | 0.4237 |
| hCV2783590 | rs6478486 | hCV30830458 | rs10733651 | 0.51 | 0.400501157 | 0.4237 |
| hCV2783590 | rs6478486 | hCV30830468 | rs10818507 | 0.51 | 0.400501157 | 0.4819 |
| hCV2783590 | rs6478486 | hCV30830473 | rs7036649 | 0.51 | 0.400501157 | 0.5014 |
| hCV2783590 | rs6478486 | hCV30830475 | rs10733652 | 0.51 | 0.400501157 | 0.4539 |
| hCV2783590 | rs6478486 | hCV30830484 | rs10818508 | 0.51 | 0.400501157 | 0.4989 |
| hCV2783590 | rs6478486 | hCV30830486 | rs10760149 | 0.51 | 0.400501157 | 0.4989 |
| hCV2783590 | rs6478486 | hCV30830503 | rs4837811 | 0.51 | 0.400501157 | 0.4989 |
| hCV2783590 | rs6478486 | hCV30830512 | rs10818512 | 0.51 | 0.400501157 | 0.4734 |
| hCV2783590 | rs6478486 | hCV30830521 | rs10818513 | 0.51 | 0.400501157 | 0.4734 |
| hCV2783590 | rs6478486 | hCV30830536 | rs7047038 | 0.51 | 0.400501157 | 0.4734 |
| hCV2783590 | rs6478486 | hCV30830538 | rs10760152 | 0.51 | 0.400501157 | 0.4168 |
| hCV2783590 | rs6478486 | hCV30830638 | rs10985073 | 0.51 | 0.400501157 | 0.6691 |
| hCV2783590 | rs6478486 | hCV30830725 | rs7864019 | 0.51 | 0.400501157 | 0.9666 |
| hCV2783590 | rs6478486 | hCV30830832 | rs10733648 | 0.51 | 0.400501157 | 0.9666 |
| hCV2783590 | rs6478486 | hCV30830909 | rs11794516 | 0.51 | 0.400501157 | 0.6691 |
| hCV2783590 | rs6478486 | hCV7577250 | rs942153 | 0.51 | 0.400501157 | 0.4734 |
| hCV2783590 | rs6478486 | hCV7577271 | rs1535655 | 0.51 | 0.400501157 | 0.4734 |
| hCV2783590 | rs6478486 | hCV7577286 | rs1407912 | 0.51 | 0.400501157 | 0.4237 |
| hCV2783590 | rs6478486 | hCV7577287 | rs1323478 | 0.51 | 0.400501157 | 0.4989 |
| hCV2783590 | rs6478486 | hCV7577296 | rs1407910 | 0.51 | 0.400501157 | 0.4989 |
| hCV2783590 | rs6478486 | hCV7577311 | rs1323473 | 0.51 | 0.400501157 | 0.4466 |
| hCV2783590 | rs6478486 | hCV7577317 | rs1323472 | 0.51 | 0.400501157 | 0.404 |
| hCV2783590 | rs6478486 | hCV7577328 | rs1323476 | 0.51 | 0.400501157 | 0.4414 |
| hCV2783590 | rs6478486 | hCV7577331 | rs1468673 | 0.51 | 0.400501157 | 0.404 |
| hCV2783590 | rs6478486 | hCV7577332 | rs1468672 | 0.51 | 0.400501157 | 0.4414 |
| hCV2783590 | rs6478486 | hCV7577344 | rs876445 | 0.51 | 0.400501157 | 0.9666 |
| hCV2783590 | rs6478486 | hCV782872 | rs758958 | 0.51 | 0.400501157 | 0.4414 |
| hCV2783597 | rs1860824 | hCV11266229 | rs10435844 | 0.51 | 0.424042897 | 1 |
| hCV2783597 | rs1860824 | hCV11266268 | rs10760121 | 0.51 | 0.424042897 | 0.965 |
| hCV2783597 | rs1860824 | hCV11720350 | rs2057469 | 0.51 | 0.424042897 | 0.4487 |
| hCV2783597 | rs1860824 | hCV11720413 | rs1930782 | 0.51 | 0.424042897 | 0.6581 |
| hCV2783597 | rs1860824 | hCV11720414 | rs1930781 | 0.51 | 0.424042897 | 1 |
| hCV2783597 | rs1860824 | hCV15849105 | rs2900185 | 0.51 | 0.424042897 | 0.4737 |
| hCV2783597 | rs1860824 | hCV15849116 | rs2900180 | 0.51 | 0.424042897 | 1 |
| hCV2783597 | rs1860824 | hCV15870898 | rs2072438 | 0.51 | 0.424042897 | 0.6357 |
| hCV2783597 | rs1860824 | hCV16124825 | rs2109895 | 0.51 | 0.424042897 | 1 |

TABLE 4-continued

| Interrogated SNP | Interrogated rs | LD SNP | LD SNP rs | Power | Threshold r² | r² |
|---|---|---|---|---|---|---|
| hCV2783597 | rs1860824 | hCV16175379 | rs2239657 | 0.51 | 0.424042897 | 0.9647 |
| hCV2783597 | rs1860824 | hCV16234795 | rs2416804 | 0.51 | 0.424042897 | 0.6215 |
| hCV2783597 | rs1860824 | hCV16234838 | rs2416819 | 0.51 | 0.424042897 | 0.4487 |
| hCV2783597 | rs1860824 | hCV16234840 | rs2416817 | 0.51 | 0.424042897 | 0.4737 |
| hCV2783597 | rs1860824 | hCV1632195 | rs1998505 | 0.51 | 0.424042897 | 0.4737 |
| hCV2783597 | rs1860824 | hCV1761888 | rs1953126 | 0.51 | 0.424042897 | 0.965 |
| hCV2783597 | rs1860824 | hCV1761891 | rs1930778 | 0.51 | 0.424042897 | 0.959 |
| hCV2783597 | rs1860824 | hCV1761894 | rs1609810 | 0.51 | 0.424042897 | 0.9588 |
| hCV2783597 | rs1860824 | hCV2359565 | rs1014530 | 0.51 | 0.424042897 | 0.6581 |
| hCV2783597 | rs1860824 | hCV25613469 | rs10760157 | 0.51 | 0.424042897 | 0.4487 |
| hCV2783597 | rs1860824 | hCV25751916 | rs10985070 | 0.51 | 0.424042897 | 0.6357 |
| hCV2783597 | rs1860824 | hCV25771057 | rs10760150 | 0.51 | 0.424042897 | 0.4737 |
| hCV2783597 | rs1860824 | hCV2783582 | rs10818482 | 0.51 | 0.424042897 | 0.6357 |
| hCV2783597 | rs1860824 | hCV2783586 | rs2270231 | 0.51 | 0.424042897 | 0.965 |
| hCV2783597 | rs1860824 | hCV2783589 | rs881375 | 0.51 | 0.424042897 | 0.965 |
| hCV2783597 | rs1860824 | hCV2783590 | rs6478486 | 0.51 | 0.424042897 | 0.965 |
| hCV2783597 | rs1860824 | hCV2783591 | rs1468671 | 0.51 | 0.424042897 | 1 |
| hCV2783597 | rs1860824 | hCV2783593 | rs1548783 | 0.51 | 0.424042897 | 1 |
| hCV2783597 | rs1860824 | hCV2783599 | rs7046108 | 0.51 | 0.424042897 | 1 |
| hCV2783597 | rs1860824 | hCV2783604 | rs10760126 | 0.51 | 0.424042897 | 0.6773 |
| hCV2783597 | rs1860824 | hCV2783607 | rs9886724 | 0.51 | 0.424042897 | 0.6676 |
| hCV2783597 | rs1860824 | hCV2783608 | rs4836834 | 0.51 | 0.424042897 | 0.6581 |
| hCV2783597 | rs1860824 | hCV2783609 | rs2241003 | 0.51 | 0.424042897 | 0.9289 |
| hCV2783597 | rs1860824 | hCV2783611 | rs10435843 | 0.51 | 0.424042897 | 1 |
| hCV2783597 | rs1860824 | hCV2783618 | rs2239658 | 0.51 | 0.424042897 | 1 |
| hCV2783597 | rs1860824 | hCV2783620 | rs7021880 | 0.51 | 0.424042897 | 0.9627 |
| hCV2783597 | rs1860824 | hCV2783621 | rs2416805 | 0.51 | 0.424042897 | 1 |
| hCV2783597 | rs1860824 | hCV2783622 | rs758959 | 0.51 | 0.424042897 | 1 |
| hCV2783597 | rs1860824 | hCV2783625 | rs10118357 | 0.51 | 0.424042897 | 0.6539 |
| hCV2783597 | rs1860824 | hCV2783630 | rs2269060 | 0.51 | 0.424042897 | 0.6581 |
| hCV2783597 | rs1860824 | hCV2783633 | rs7021049 | 0.51 | 0.424042897 | 0.6581 |
| hCV2783597 | rs1860824 | hCV2783634 | rs1014529 | 0.51 | 0.424042897 | 1 |
| hCV2783597 | rs1860824 | hCV2783635 | rs1930780 | 0.51 | 0.424042897 | 1 |
| hCV2783597 | rs1860824 | hCV2783638 | rs3761846 | 0.51 | 0.424042897 | 0.6581 |
| hCV2783597 | rs1860824 | hCV2783640 | rs3761847 | 0.51 | 0.424042897 | 0.6215 |
| hCV2783597 | rs1860824 | hCV2783641 | rs2416806 | 0.51 | 0.424042897 | 1 |
| hCV2783597 | rs1860824 | hCV2783647 | rs10739580 | 0.51 | 0.424042897 | 1 |
| hCV2783597 | rs1860824 | hCV2783650 | rs10760129 | 0.51 | 0.424042897 | 0.6581 |
| hCV2783597 | rs1860824 | hCV2783653 | rs10760130 | 0.51 | 0.424042897 | 0.6581 |
| hCV2783597 | rs1860824 | hCV2783655 | rs10818488 | 0.51 | 0.424042897 | 0.6581 |
| hCV2783597 | rs1860824 | hCV2783656 | rs4837804 | 0.51 | 0.424042897 | 0.8909 |
| hCV2783597 | rs1860824 | hCV2783659 | rs7039505 | 0.51 | 0.424042897 | 1 |
| hCV2783597 | rs1860824 | hCV27912350 | rs4837808 | 0.51 | 0.424042897 | 0.4737 |
| hCV2783597 | rs1860824 | hCV27912351 | rs4837809 | 0.51 | 0.424042897 | 0.4737 |
| hCV2783597 | rs1860824 | hCV29005923 | rs6478494 | 0.51 | 0.424042897 | 0.4396 |
| hCV2783597 | rs1860824 | hCV29005924 | rs7031128 | 0.51 | 0.424042897 | 0.4439 |
| hCV2783597 | rs1860824 | hCV29005976 | rs7037195 | 0.51 | 0.424042897 | 0.6581 |
| hCV2783597 | rs1860824 | hCV29005978 | rs7021206 | 0.51 | 0.424042897 | 1 |
| hCV2783597 | rs1860824 | hCV29006006 | rs7034390 | 0.51 | 0.424042897 | 0.965 |
| hCV2783597 | rs1860824 | hCV30059070 | rs10156413 | 0.51 | 0.424042897 | 0.5428 |
| hCV2783597 | rs1860824 | hCV3045792 | rs6478499 | 0.51 | 0.424042897 | 0.4923 |
| hCV2783597 | rs1860824 | hCV3045801 | rs2057465 | 0.51 | 0.424042897 | 0.4342 |
| hCV2783597 | rs1860824 | hCV30563729 | rs9299273 | 0.51 | 0.424042897 | 0.4737 |
| hCV2783597 | rs1860824 | hCV30830414 | rs7871371 | 0.51 | 0.424042897 | 0.4332 |
| hCV2783597 | rs1860824 | hCV30830468 | rs10818507 | 0.51 | 0.424042897 | 0.4577 |
| hCV2783597 | rs1860824 | hCV30830473 | rs7036649 | 0.51 | 0.424042897 | 0.4725 |
| hCV2783597 | rs1860824 | hCV30830475 | rs10733652 | 0.51 | 0.424042897 | 0.4293 |
| hCV2783597 | rs1860824 | hCV30830484 | rs10818508 | 0.51 | 0.424042897 | 0.4737 |
| hCV2783597 | rs1860824 | hCV30830486 | rs10760149 | 0.51 | 0.424042897 | 0.4737 |
| hCV2783597 | rs1860824 | hCV30830503 | rs4837811 | 0.51 | 0.424042897 | 0.4737 |
| hCV2783597 | rs1860824 | hCV30830512 | rs10818512 | 0.51 | 0.424042897 | 0.4487 |
| hCV2783597 | rs1860824 | hCV30830521 | rs10818513 | 0.51 | 0.424042897 | 0.4487 |
| hCV2783597 | rs1860824 | hCV30830536 | rs7047038 | 0.51 | 0.424042897 | 0.4487 |
| hCV2783597 | rs1860824 | hCV30830638 | rs10985073 | 0.51 | 0.424042897 | 0.6357 |
| hCV2783597 | rs1860824 | hCV30830725 | rs7864019 | 0.51 | 0.424042897 | 1 |
| hCV2783597 | rs1860824 | hCV30830832 | rs10733648 | 0.51 | 0.424042897 | 1 |
| hCV2783597 | rs1860824 | hCV30830909 | rs11794516 | 0.51 | 0.424042897 | 0.6357 |
| hCV2783597 | rs1860824 | hCV7577250 | rs942153 | 0.51 | 0.424042897 | 0.4487 |
| hCV2783597 | rs1860824 | hCV7577271 | rs1535655 | 0.51 | 0.424042897 | 0.4487 |
| hCV2783597 | rs1860824 | hCV7577287 | rs1323478 | 0.51 | 0.424042897 | 0.4737 |
| hCV2783597 | rs1860824 | hCV7577296 | rs1407910 | 0.51 | 0.424042897 | 0.4737 |
| hCV2783597 | rs1860824 | hCV7577311 | rs1323473 | 0.51 | 0.424042897 | 0.4249 |
| hCV2783597 | rs1860824 | hCV7577344 | rs876445 | 0.51 | 0.424042897 | 1 |
| hCV2783604 | rs10760126 | hCV11266229 | rs10435844 | 0.51 | 0.330072784 | 0.6875 |
| hCV2783604 | rs10760126 | hCV11266268 | rs10760121 | 0.51 | 0.330072784 | 0.6526 |
| hCV2783604 | rs10760126 | hCV11720351 | rs1885995 | 0.51 | 0.330072784 | 0.4639 |
| hCV2783604 | rs10760126 | hCV11720413 | rs1930782 | 0.51 | 0.330072784 | 1 |

TABLE 4-continued

| Interrogated SNP | Interrogated rs | LD SNP | LD SNP rs | Power | Threshold r² | r² |
|---|---|---|---|---|---|---|
| hCV2783604 | rs10760126 | hCV11720414 | rs1930781 | 0.51 | 0.330072784 | 0.6875 |
| hCV2783604 | rs10760126 | hCV1452630 | rs10818476 | 0.51 | 0.330072784 | 0.362 |
| hCV2783604 | rs10760126 | hCV1452651 | rs3793638 | 0.51 | 0.330072784 | 0.3397 |
| hCV2783604 | rs10760126 | hCV1452652 | rs1060817 | 0.51 | 0.330072784 | 0.3397 |
| hCV2783604 | rs10760126 | hCV1452665 | rs4837796 | 0.51 | 0.330072784 | 0.362 |
| hCV2783604 | rs10760126 | hCV15751717 | rs2296077 | 0.51 | 0.330072784 | 0.404 |
| hCV2783604 | rs10760126 | hCV15751719 | rs2146838 | 0.51 | 0.330072784 | 0.4639 |
| hCV2783604 | rs10760126 | hCV15757738 | rs2302498 | 0.51 | 0.330072784 | 0.4182 |
| hCV2783604 | rs10760126 | hCV15849116 | rs2900180 | 0.51 | 0.330072784 | 0.6795 |
| hCV2783604 | rs10760126 | hCV15870898 | rs2072438 | 0.51 | 0.330072784 | 0.9666 |
| hCV2783604 | rs10760126 | hCV16124825 | rs2109895 | 0.51 | 0.330072784 | 0.6875 |
| hCV2783604 | rs10760126 | hCV16175379 | rs2239657 | 0.51 | 0.330072784 | 0.6641 |
| hCV2783604 | rs10760126 | hCV16234795 | rs2416804 | 0.51 | 0.330072784 | 0.9666 |
| hCV2783604 | rs10760126 | hCV1761888 | rs1953126 | 0.51 | 0.330072784 | 0.6526 |
| hCV2783604 | rs10760126 | hCV1761891 | rs1930778 | 0.51 | 0.330072784 | 0.5969 |
| hCV2783604 | rs10760126 | hCV1761894 | rs1609810 | 0.51 | 0.330072784 | 0.6271 |
| hCV2783604 | rs10760126 | hCV22272588 | rs10760117 | 0.51 | 0.330072784 | 0.362 |
| hCV2783604 | rs10760126 | hCV2359565 | rs1014530 | 0.51 | 0.330072784 | 1 |
| hCV2783604 | rs10760126 | hCV25751916 | rs10985070 | 0.51 | 0.330072784 | 0.9666 |
| hCV2783604 | rs10760126 | hCV26144307 | rs1016468 | 0.51 | 0.330072784 | 0.4639 |
| hCV2783604 | rs10760126 | hCV26144332 | rs4837813 | 0.51 | 0.330072784 | 0.4432 |
| hCV2783604 | rs10760126 | hCV2783582 | rs10818482 | 0.51 | 0.330072784 | 0.9666 |
| hCV2783604 | rs10760126 | hCV2783586 | rs2270231 | 0.51 | 0.330072784 | 0.6526 |
| hCV2783604 | rs10760126 | hCV2783589 | rs881375 | 0.51 | 0.330072784 | 0.6526 |
| hCV2783604 | rs10760126 | hCV2783590 | rs6478486 | 0.51 | 0.330072784 | 0.6526 |
| hCV2783604 | rs10760126 | hCV2783591 | rs1468671 | 0.51 | 0.330072784 | 0.6875 |
| hCV2783604 | rs10760126 | hCV2783593 | rs1548783 | 0.51 | 0.330072784 | 0.6834 |
| hCV2783604 | rs10760126 | hCV2783597 | rs1860824 | 0.51 | 0.330072784 | 0.6773 |
| hCV2783604 | rs10760126 | hCV2783599 | rs7046108 | 0.51 | 0.330072784 | 0.6875 |
| hCV2783604 | rs10760126 | hCV2783607 | rs9886724 | 0.51 | 0.330072784 | 1 |
| hCV2783604 | rs10760126 | hCV2783608 | rs4836834 | 0.51 | 0.330072784 | 1 |
| hCV2783604 | rs10760126 | hCV2783609 | rs2241003 | 0.51 | 0.330072784 | 0.7286 |
| hCV2783604 | rs10760126 | hCV2783611 | rs10435843 | 0.51 | 0.330072784 | 0.6875 |
| hCV2783604 | rs10760126 | hCV2783618 | rs2239658 | 0.51 | 0.330072784 | 0.6875 |
| hCV2783604 | rs10760126 | hCV2783620 | rs7021880 | 0.51 | 0.330072784 | 0.6261 |
| hCV2783604 | rs10760126 | hCV2783621 | rs2416805 | 0.51 | 0.330072784 | 0.6875 |
| hCV2783604 | rs10760126 | hCV2783622 | rs758959 | 0.51 | 0.330072784 | 0.6875 |
| hCV2783604 | rs10760126 | hCV2783625 | rs10118357 | 0.51 | 0.330072784 | 1 |
| hCV2783604 | rs10760126 | hCV2783630 | rs2269060 | 0.51 | 0.330072784 | 1 |
| hCV2783604 | rs10760126 | hCV2783633 | rs7021049 | 0.51 | 0.330072784 | 1 |
| hCV2783604 | rs10760126 | hCV2783634 | rs1014529 | 0.51 | 0.330072784 | 0.6875 |
| hCV2783604 | rs10760126 | hCV2783635 | rs1930780 | 0.51 | 0.330072784 | 0.6875 |
| hCV2783604 | rs10760126 | hCV2783638 | rs3761846 | 0.51 | 0.330072784 | 1 |
| hCV2783604 | rs10760126 | hCV2783640 | rs3761847 | 0.51 | 0.330072784 | 0.9666 |
| hCV2783604 | rs10760126 | hCV2783641 | rs2416806 | 0.51 | 0.330072784 | 0.6785 |
| hCV2783604 | rs10760126 | hCV2783647 | rs10739580 | 0.51 | 0.330072784 | 0.6875 |
| hCV2783604 | rs10760126 | hCV2783650 | rs10760129 | 0.51 | 0.330072784 | 1 |
| hCV2783604 | rs10760126 | hCV2783653 | rs10760130 | 0.51 | 0.330072784 | 1 |
| hCV2783604 | rs10760126 | hCV2783655 | rs10818488 | 0.51 | 0.330072784 | 1 |
| hCV2783604 | rs10760126 | hCV2783656 | rs4837804 | 0.51 | 0.330072784 | 0.8006 |
| hCV2783604 | rs10760126 | hCV2783659 | rs7039505 | 0.51 | 0.330072784 | 0.6774 |
| hCV2783604 | rs10760126 | hCV2783711 | rs10733650 | 0.51 | 0.330072784 | 0.3631 |
| hCV2783604 | rs10760126 | hCV2783718 | rs10818500 | 0.51 | 0.330072784 | 0.6603 |
| hCV2783604 | rs10760126 | hCV29005955 | rs7036980 | 0.51 | 0.330072784 | 0.3971 |
| hCV2783604 | rs10760126 | hCV29005976 | rs7037195 | 0.51 | 0.330072784 | 1 |
| hCV2783604 | rs10760126 | hCV29005978 | rs7021206 | 0.51 | 0.330072784 | 0.7031 |
| hCV2783604 | rs10760126 | hCV29006006 | rs7034390 | 0.51 | 0.330072784 | 0.6526 |
| hCV2783604 | rs10760126 | hCV29879049 | rs9792437 | 0.51 | 0.330072784 | 0.4385 |
| hCV2783604 | rs10760126 | hCV3045812 | rs7030849 | 0.51 | 0.330072784 | 0.4385 |
| hCV2783604 | rs10760126 | hCV30829523 | rs12343516 | 0.51 | 0.330072784 | 0.3397 |
| hCV2783604 | rs10760126 | hCV30830319 | rs7037673 | 0.51 | 0.330072784 | 0.5102 |
| hCV2783604 | rs10760126 | hCV30830325 | rs10818494 | 0.51 | 0.330072784 | 0.4062 |
| hCV2783604 | rs10760126 | hCV30830340 | rs10760134 | 0.51 | 0.330072784 | 0.3861 |
| hCV2783604 | rs10760126 | hCV30830341 | rs7040033 | 0.51 | 0.330072784 | 0.3861 |
| hCV2783604 | rs10760126 | hCV30830419 | rs10985140 | 0.51 | 0.330072784 | 0.6258 |
| hCV2783604 | rs10760126 | hCV30830474 | rs10739590 | 0.51 | 0.330072784 | 0.5091 |
| hCV2783604 | rs10760126 | hCV30830638 | rs10985073 | 0.51 | 0.330072784 | 0.9666 |
| hCV2783604 | rs10760126 | hCV30830725 | rs7864019 | 0.51 | 0.330072784 | 0.6875 |
| hCV2783604 | rs10760126 | hCV30830832 | rs10733648 | 0.51 | 0.330072784 | 0.6875 |
| hCV2783604 | rs10760126 | hCV30830909 | rs11794516 | 0.51 | 0.330072784 | 0.9666 |
| hCV2783604 | rs10760126 | hCV7577254 | rs942152 | 0.51 | 0.330072784 | 0.3708 |
| hCV2783604 | rs10760126 | hCV7577317 | rs1323472 | 0.51 | 0.330072784 | 0.6549 |
| hCV2783604 | rs10760126 | hCV7577331 | rs1468673 | 0.51 | 0.330072784 | 0.6549 |
| hCV2783604 | rs10760126 | hCV7577344 | rs876445 | 0.51 | 0.330072784 | 0.6875 |
| hCV2783604 | rs10760126 | hCV782875 | rs746182 | 0.51 | 0.330072784 | 0.4432 |
| hCV2783608 | rs4836834 | hCV11266229 | rs10435844 | 0.51 | 0.330072784 | 0.6687 |
| hCV2783608 | rs4836834 | hCV11266268 | rs10760121 | 0.51 | 0.330072784 | 0.6344 |

TABLE 4-continued

| Interrogated SNP | Interrogated rs | LD SNP | LD SNP rs | Power | Threshold r² | r² |
|---|---|---|---|---|---|---|
| hCV2783608 | rs4836834 | hCV11720351 | rs1885995 | 0.51 | 0.330072784 | 0.472 |
| hCV2783608 | rs4836834 | hCV11720402 | rs17611 | 0.51 | 0.330072784 | 0.3301 |
| hCV2783608 | rs4836834 | hCV11720413 | rs1930782 | 0.51 | 0.330072784 | 1 |
| hCV2783608 | rs4836834 | hCV11720414 | rs1930781 | 0.51 | 0.330072784 | 0.6687 |
| hCV2783608 | rs4836834 | hCV1452630 | rs10818476 | 0.51 | 0.330072784 | 0.3495 |
| hCV2783608 | rs4836834 | hCV1452665 | rs4837796 | 0.51 | 0.330072784 | 0.3495 |
| hCV2783608 | rs4836834 | hCV15751717 | rs2296077 | 0.51 | 0.330072784 | 0.4129 |
| hCV2783608 | rs4836834 | hCV15751719 | rs2146838 | 0.51 | 0.330072784 | 0.472 |
| hCV2783608 | rs4836834 | hCV15757738 | rs2302498 | 0.51 | 0.330072784 | 0.4266 |
| hCV2783608 | rs4836834 | hCV15849116 | rs2900180 | 0.51 | 0.330072784 | 0.6587 |
| hCV2783608 | rs4836834 | hCV15870898 | rs2072438 | 0.51 | 0.330072784 | 0.9671 |
| hCV2783608 | rs4836834 | hCV16124825 | rs2109895 | 0.51 | 0.330072784 | 0.6687 |
| hCV2783608 | rs4836834 | hCV16175379 | rs2239657 | 0.51 | 0.330072784 | 0.6463 |
| hCV2783608 | rs4836834 | hCV16234785 | rs2416811 | 0.51 | 0.330072784 | 0.3301 |
| hCV2783608 | rs4836834 | hCV16234795 | rs2416804 | 0.51 | 0.330072784 | 0.9672 |
| hCV2783608 | rs4836834 | hCV1761888 | rs1953126 | 0.51 | 0.330072784 | 0.6344 |
| hCV2783608 | rs4836834 | hCV1761891 | rs1930778 | 0.51 | 0.330072784 | 0.5775 |
| hCV2783608 | rs4836834 | hCV1761894 | rs1609810 | 0.51 | 0.330072784 | 0.6068 |
| hCV2783608 | rs4836834 | hCV22272588 | rs10760117 | 0.51 | 0.330072784 | 0.3495 |
| hCV2783608 | rs4836834 | hCV2359565 | rs1014530 | 0.51 | 0.330072784 | 1 |
| hCV2783608 | rs4836834 | hCV2359571 | rs25681 | 0.51 | 0.330072784 | 0.3301 |
| hCV2783608 | rs4836834 | hCV25751916 | rs10985070 | 0.51 | 0.330072784 | 0.9671 |
| hCV2783608 | rs4836834 | hCV26144282 | rs10818499 | 0.51 | 0.330072784 | 0.3301 |
| hCV2783608 | rs4836834 | hCV26144291 | rs4570235 | 0.51 | 0.330072784 | 0.3301 |
| hCV2783608 | rs4836834 | hCV26144307 | rs1016468 | 0.51 | 0.330072784 | 0.472 |
| hCV2783608 | rs4836834 | hCV26144332 | rs4837813 | 0.51 | 0.330072784 | 0.4513 |
| hCV2783608 | rs4836834 | hCV2783582 | rs10818482 | 0.51 | 0.330072784 | 0.9671 |
| hCV2783608 | rs4836834 | hCV2783586 | rs2270231 | 0.51 | 0.330072784 | 0.6344 |
| hCV2783608 | rs4836834 | hCV2783589 | rs881375 | 0.51 | 0.330072784 | 0.6344 |
| hCV2783608 | rs4836834 | hCV2783590 | rs6478486 | 0.51 | 0.330072784 | 0.6344 |
| hCV2783608 | rs4836834 | hCV2783591 | rs1468671 | 0.51 | 0.330072784 | 0.6687 |
| hCV2783608 | rs4836834 | hCV2783593 | rs1548783 | 0.51 | 0.330072784 | 0.6645 |
| hCV2783608 | rs4836834 | hCV2783597 | rs1860824 | 0.51 | 0.330072784 | 0.6581 |
| hCV2783608 | rs4836834 | hCV2783599 | rs7046108 | 0.51 | 0.330072784 | 0.6687 |
| hCV2783608 | rs4836834 | hCV2783604 | rs10760126 | 0.51 | 0.330072784 | 1 |
| hCV2783608 | rs4836834 | hCV2783607 | rs9886724 | 0.51 | 0.330072784 | 1 |
| hCV2783608 | rs4836834 | hCV2783609 | rs2241003 | 0.51 | 0.330072784 | 0.7074 |
| hCV2783608 | rs4836834 | hCV2783611 | rs10435843 | 0.51 | 0.330072784 | 0.6687 |
| hCV2783608 | rs4836834 | hCV2783618 | rs2239658 | 0.51 | 0.330072784 | 0.6687 |
| hCV2783608 | rs4836834 | hCV2783620 | rs7021880 | 0.51 | 0.330072784 | 0.6088 |
| hCV2783608 | rs4836834 | hCV2783621 | rs2416805 | 0.51 | 0.330072784 | 0.6687 |
| hCV2783608 | rs4836834 | hCV2783622 | rs758959 | 0.51 | 0.330072784 | 0.6687 |
| hCV2783608 | rs4836834 | hCV2783625 | rs10118357 | 0.51 | 0.330072784 | 1 |
| hCV2783608 | rs4836834 | hCV2783630 | rs2269060 | 0.51 | 0.330072784 | 1 |
| hCV2783608 | rs4836834 | hCV2783633 | rs7021049 | 0.51 | 0.330072784 | 1 |
| hCV2783608 | rs4836834 | hCV2783634 | rs1014529 | 0.51 | 0.330072784 | 0.6687 |
| hCV2783608 | rs4836834 | hCV2783635 | rs1930780 | 0.51 | 0.330072784 | 0.6687 |
| hCV2783608 | rs4836834 | hCV2783638 | rs3761846 | 0.51 | 0.330072784 | 1 |
| hCV2783608 | rs4836834 | hCV2783640 | rs3761847 | 0.51 | 0.330072784 | 0.9672 |
| hCV2783608 | rs4836834 | hCV2783641 | rs2416806 | 0.51 | 0.330072784 | 0.6594 |
| hCV2783608 | rs4836834 | hCV2783647 | rs10739580 | 0.51 | 0.330072784 | 0.6687 |
| hCV2783608 | rs4836834 | hCV2783650 | rs10760129 | 0.51 | 0.330072784 | 1 |
| hCV2783608 | rs4836834 | hCV2783653 | rs10760130 | 0.51 | 0.330072784 | 1 |
| hCV2783608 | rs4836834 | hCV2783655 | rs10818488 | 0.51 | 0.330072784 | 1 |
| hCV2783608 | rs4836834 | hCV2783656 | rs4837804 | 0.51 | 0.330072784 | 0.775 |
| hCV2783608 | rs4836834 | hCV2783659 | rs7039505 | 0.51 | 0.330072784 | 0.6562 |
| hCV2783608 | rs4836834 | hCV2783711 | rs10733650 | 0.51 | 0.330072784 | 0.3723 |
| hCV2783608 | rs4836834 | hCV2783718 | rs10818500 | 0.51 | 0.330072784 | 0.6661 |
| hCV2783608 | rs4836834 | hCV29005955 | rs7036980 | 0.51 | 0.330072784 | 0.4056 |
| hCV2783608 | rs4836834 | hCV29005976 | rs7037195 | 0.51 | 0.330072784 | 1 |
| hCV2783608 | rs4836834 | hCV29005978 | rs7021206 | 0.51 | 0.330072784 | 0.7031 |
| hCV2783608 | rs4836834 | hCV29006006 | rs7034390 | 0.51 | 0.330072784 | 0.6344 |
| hCV2783608 | rs4836834 | hCV29879049 | rs9792437 | 0.51 | 0.330072784 | 0.4468 |
| hCV2783608 | rs4836834 | hCV3045812 | rs7030849 | 0.51 | 0.330072784 | 0.4468 |
| hCV2783608 | rs4836834 | hCV30830319 | rs7037673 | 0.51 | 0.330072784 | 0.517 |
| hCV2783608 | rs4836834 | hCV30830325 | rs10818494 | 0.51 | 0.330072784 | 0.4154 |
| hCV2783608 | rs4836834 | hCV30830340 | rs10760134 | 0.51 | 0.330072784 | 0.3949 |
| hCV2783608 | rs4836834 | hCV30830341 | rs7040033 | 0.51 | 0.330072784 | 0.3949 |
| hCV2783608 | rs4836834 | hCV30830419 | rs10985140 | 0.51 | 0.330072784 | 0.6317 |
| hCV2783608 | rs4836834 | hCV30830474 | rs10739590 | 0.51 | 0.330072784 | 0.5169 |
| hCV2783608 | rs4836834 | hCV30830638 | rs10985073 | 0.51 | 0.330072784 | 0.9671 |
| hCV2783608 | rs4836834 | hCV30830725 | rs7864019 | 0.51 | 0.330072784 | 0.6687 |
| hCV2783608 | rs4836834 | hCV30830832 | rs10733648 | 0.51 | 0.330072784 | 0.6687 |
| hCV2783608 | rs4836834 | hCV30830909 | rs11794516 | 0.51 | 0.330072784 | 0.9671 |
| hCV2783608 | rs4836834 | hCV7577254 | rs942152 | 0.51 | 0.330072784 | 0.3797 |
| hCV2783608 | rs4836834 | hCV7577317 | rs1323472 | 0.51 | 0.330072784 | 0.6604 |
| hCV2783608 | rs4836834 | hCV7577331 | rs1468673 | 0.51 | 0.330072784 | 0.6604 |

TABLE 4-continued

| Interrogated SNP | Interrogated rs | LD SNP | LD SNP rs | Power | Threshold r² | r² |
|---|---|---|---|---|---|---|
| hCV2783608 | rs4836834 | hCV7577337 | rs993247 | 0.51 | 0.330072784 | 0.3301 |
| hCV2783608 | rs4836834 | hCV7577344 | rs876445 | 0.51 | 0.330072784 | 0.6687 |
| hCV2783608 | rs4836834 | hCV782875 | rs746182 | 0.51 | 0.330072784 | 0.4513 |
| hCV2783618 | rs2239658 | hCV11266229 | rs10435844 | 0.51 | 0.423423973 | 1 |
| hCV2783618 | rs2239658 | hCV11266268 | rs10760121 | 0.51 | 0.423423973 | 0.9666 |
| hCV2783618 | rs2239658 | hCV11720350 | rs2057469 | 0.51 | 0.423423973 | 0.4465 |
| hCV2783618 | rs2239658 | hCV11720413 | rs1930782 | 0.51 | 0.423423973 | 0.6687 |
| hCV2783618 | rs2239658 | hCV11720414 | rs1930781 | 0.51 | 0.423423973 | 1 |
| hCV2783618 | rs2239658 | hCV15849105 | rs2900185 | 0.51 | 0.423423973 | 0.4708 |
| hCV2783618 | rs2239658 | hCV15849116 | rs2900180 | 0.51 | 0.423423973 | 1 |
| hCV2783618 | rs2239658 | hCV15870898 | rs2072438 | 0.51 | 0.423423973 | 0.6467 |
| hCV2783618 | rs2239658 | hCV16124825 | rs2109895 | 0.51 | 0.423423973 | 1 |
| hCV2783618 | rs2239658 | hCV16175379 | rs2239657 | 0.51 | 0.423423973 | 0.9664 |
| hCV2783618 | rs2239658 | hCV16234795 | rs2416804 | 0.51 | 0.423423973 | 0.6341 |
| hCV2783618 | rs2239658 | hCV16234838 | rs2416819 | 0.51 | 0.423423973 | 0.4465 |
| hCV2783618 | rs2239658 | hCV16234840 | rs2416817 | 0.51 | 0.423423973 | 0.4708 |
| hCV2783618 | rs2239658 | hCV1632195 | rs1998505 | 0.51 | 0.423423973 | 0.4708 |
| hCV2783618 | rs2239658 | hCV1761888 | rs1953126 | 0.51 | 0.423423973 | 0.9666 |
| hCV2783618 | rs2239658 | hCV1761891 | rs1930778 | 0.51 | 0.423423973 | 0.9602 |
| hCV2783618 | rs2239658 | hCV1761894 | rs1609810 | 0.51 | 0.423423973 | 0.9609 |
| hCV2783618 | rs2239658 | hCV2359565 | rs1014530 | 0.51 | 0.423423973 | 0.6687 |
| hCV2783618 | rs2239658 | hCV25613469 | rs10760157 | 0.51 | 0.423423973 | 0.4465 |
| hCV2783618 | rs2239658 | hCV25751916 | rs10985070 | 0.51 | 0.423423973 | 0.6467 |
| hCV2783618 | rs2239658 | hCV25771057 | rs10760150 | 0.51 | 0.423423973 | 0.4708 |
| hCV2783618 | rs2239658 | hCV2783582 | rs10818482 | 0.51 | 0.423423973 | 0.6467 |
| hCV2783618 | rs2239658 | hCV2783586 | rs2270231 | 0.51 | 0.423423973 | 0.9666 |
| hCV2783618 | rs2239658 | hCV2783589 | rs881375 | 0.51 | 0.423423973 | 0.9666 |
| hCV2783618 | rs2239658 | hCV2783590 | rs6478486 | 0.51 | 0.423423973 | 0.9666 |
| hCV2783618 | rs2239658 | hCV2783591 | rs1468671 | 0.51 | 0.423423973 | 1 |
| hCV2783618 | rs2239658 | hCV2783593 | rs1548783 | 0.51 | 0.423423973 | 1 |
| hCV2783618 | rs2239658 | hCV2783597 | rs1860824 | 0.51 | 0.423423973 | 1 |
| hCV2783618 | rs2239658 | hCV2783599 | rs7046108 | 0.51 | 0.423423973 | 1 |
| hCV2783618 | rs2239658 | hCV2783604 | rs10760126 | 0.51 | 0.423423973 | 0.6875 |
| hCV2783618 | rs2239658 | hCV2783607 | rs9886724 | 0.51 | 0.423423973 | 0.6785 |
| hCV2783618 | rs2239658 | hCV2783608 | rs4836834 | 0.51 | 0.423423973 | 0.6687 |
| hCV2783618 | rs2239658 | hCV2783609 | rs2241003 | 0.51 | 0.423423973 | 0.9321 |
| hCV2783618 | rs2239658 | hCV2783611 | rs10435843 | 0.51 | 0.423423973 | 1 |
| hCV2783618 | rs2239658 | hCV2783620 | rs7021880 | 0.51 | 0.423423973 | 0.9301 |
| hCV2783618 | rs2239658 | hCV2783621 | rs2416805 | 0.51 | 0.423423973 | 1 |
| hCV2783618 | rs2239658 | hCV2783622 | rs758959 | 0.51 | 0.423423973 | 1 |
| hCV2783618 | rs2239658 | hCV2783625 | rs10118357 | 0.51 | 0.423423973 | 0.6645 |
| hCV2783618 | rs2239658 | hCV2783630 | rs2269060 | 0.51 | 0.423423973 | 0.6687 |
| hCV2783618 | rs2239658 | hCV2783633 | rs7021049 | 0.51 | 0.423423973 | 0.6687 |
| hCV2783618 | rs2239658 | hCV2783634 | rs1014529 | 0.51 | 0.423423973 | 1 |
| hCV2783618 | rs2239658 | hCV2783635 | rs1930780 | 0.51 | 0.423423973 | 1 |
| hCV2783618 | rs2239658 | hCV2783638 | rs3761846 | 0.51 | 0.423423973 | 0.6687 |
| hCV2783618 | rs2239658 | hCV2783640 | rs3761847 | 0.51 | 0.423423973 | 0.6341 |
| hCV2783618 | rs2239658 | hCV2783641 | rs2416806 | 0.51 | 0.423423973 | 1 |
| hCV2783618 | rs2239658 | hCV2783647 | rs10739580 | 0.51 | 0.423423973 | 1 |
| hCV2783618 | rs2239658 | hCV2783650 | rs10760129 | 0.51 | 0.423423973 | 0.6687 |
| hCV2783618 | rs2239658 | hCV2783653 | rs10760130 | 0.51 | 0.423423973 | 0.6687 |
| hCV2783618 | rs2239658 | hCV2783655 | rs10818488 | 0.51 | 0.423423973 | 0.6687 |
| hCV2783618 | rs2239658 | hCV2783656 | rs4837804 | 0.51 | 0.423423973 | 0.8956 |
| hCV2783618 | rs2239658 | hCV2783659 | rs7039505 | 0.51 | 0.423423973 | 1 |
| hCV2783618 | rs2239658 | hCV27912350 | rs4837808 | 0.51 | 0.423423973 | 0.4708 |
| hCV2783618 | rs2239658 | hCV27912351 | rs4837809 | 0.51 | 0.423423973 | 0.4708 |
| hCV2783618 | rs2239658 | hCV29005923 | rs6478494 | 0.51 | 0.423423973 | 0.4238 |
| hCV2783618 | rs2239658 | hCV29005924 | rs7031128 | 0.51 | 0.423423973 | 0.4264 |
| hCV2783618 | rs2239658 | hCV29005976 | rs7037195 | 0.51 | 0.423423973 | 0.6687 |
| hCV2783618 | rs2239658 | hCV29005978 | rs7021206 | 0.51 | 0.423423973 | 1 |
| hCV2783618 | rs2239658 | hCV29006006 | rs7034390 | 0.51 | 0.423423973 | 0.9666 |
| hCV2783618 | rs2239658 | hCV30059070 | rs10156413 | 0.51 | 0.423423973 | 0.5258 |
| hCV2783618 | rs2239658 | hCV3045792 | rs6478499 | 0.51 | 0.423423973 | 0.4879 |
| hCV2783618 | rs2239658 | hCV3045801 | rs2057465 | 0.51 | 0.423423973 | 0.4332 |
| hCV2783618 | rs2239658 | hCV30563729 | rs9299273 | 0.51 | 0.423423973 | 0.4708 |
| hCV2783618 | rs2239658 | hCV30830468 | rs10818507 | 0.51 | 0.423423973 | 0.4539 |
| hCV2783618 | rs2239658 | hCV30830473 | rs7036649 | 0.51 | 0.423423973 | 0.4705 |
| hCV2783618 | rs2239658 | hCV30830475 | rs10733652 | 0.51 | 0.423423973 | 0.4269 |
| hCV2783618 | rs2239658 | hCV30830484 | rs10818508 | 0.51 | 0.423423973 | 0.4708 |
| hCV2783618 | rs2239658 | hCV30830486 | rs10760149 | 0.51 | 0.423423973 | 0.4708 |
| hCV2783618 | rs2239658 | hCV30830503 | rs4837811 | 0.51 | 0.423423973 | 0.4708 |
| hCV2783618 | rs2239658 | hCV30830512 | rs10818512 | 0.51 | 0.423423973 | 0.4465 |
| hCV2783618 | rs2239658 | hCV30830521 | rs10818513 | 0.51 | 0.423423973 | 0.4465 |
| hCV2783618 | rs2239658 | hCV30830536 | rs7047038 | 0.51 | 0.423423973 | 0.4465 |
| hCV2783618 | rs2239658 | hCV30830638 | rs10985073 | 0.51 | 0.423423973 | 0.6467 |
| hCV2783618 | rs2239658 | hCV30830725 | rs7864019 | 0.51 | 0.423423973 | 1 |
| hCV2783618 | rs2239658 | hCV30830832 | rs10733648 | 0.51 | 0.423423973 | 1 |

TABLE 4-continued

| Interrogated SNP | Interrogated rs | LD SNP | LD SNP rs | Power | Threshold r² | r² |
|---|---|---|---|---|---|---|
| hCV2783618 | rs2239658 | hCV30830909 | rs11794516 | 0.51 | 0.423423973 | 0.6467 |
| hCV2783618 | rs2239658 | hCV7577250 | rs942153 | 0.51 | 0.423423973 | 0.4465 |
| hCV2783618 | rs2239658 | hCV7577271 | rs1535655 | 0.51 | 0.423423973 | 0.4465 |
| hCV2783618 | rs2239658 | hCV7577287 | rs1323478 | 0.51 | 0.423423973 | 0.4708 |
| hCV2783618 | rs2239658 | hCV7577296 | rs1407910 | 0.51 | 0.423423973 | 0.4708 |
| hCV2783618 | rs2239658 | hCV7577344 | rs876445 | 0.51 | 0.423423973 | 1 |
| hCV2783620 | rs7021880 | hCV11266229 | rs10435844 | 0.51 | 0.304581904 | 0.9301 |
| hCV2783620 | rs7021880 | hCV11266268 | rs10760121 | 0.51 | 0.304581904 | 0.8974 |
| hCV2783620 | rs7021880 | hCV11720348 | rs2057470 | 0.51 | 0.304581904 | 0.3276 |
| hCV2783620 | rs7021880 | hCV11720350 | rs2057469 | 0.51 | 0.304581904 | 0.438 |
| hCV2783620 | rs7021880 | hCV11720386 | rs1998506 | 0.51 | 0.304581904 | 0.388 |
| hCV2783620 | rs7021880 | hCV11720394 | rs1924081 | 0.51 | 0.304581904 | 0.3506 |
| hCV2783620 | rs7021880 | hCV11720413 | rs1930782 | 0.51 | 0.304581904 | 0.6088 |
| hCV2783620 | rs7021880 | hCV11720414 | rs1930781 | 0.51 | 0.304581904 | 0.9301 |
| hCV2783620 | rs7021880 | hCV1452630 | rs10818476 | 0.51 | 0.304581904 | 0.3276 |
| hCV2783620 | rs7021880 | hCV1452665 | rs4837796 | 0.51 | 0.304581904 | 0.3276 |
| hCV2783620 | rs7021880 | hCV15849105 | rs2900185 | 0.51 | 0.304581904 | 0.4634 |
| hCV2783620 | rs7021880 | hCV15849116 | rs2900180 | 0.51 | 0.304581904 | 0.9252 |
| hCV2783620 | rs7021880 | hCV15870898 | rs2072438 | 0.51 | 0.304581904 | 0.5878 |
| hCV2783620 | rs7021880 | hCV16077967 | rs2159776 | 0.51 | 0.304581904 | 0.3489 |
| hCV2783620 | rs7021880 | hCV16124825 | rs2109895 | 0.51 | 0.304581904 | 0.9301 |
| hCV2783620 | rs7021880 | hCV16175379 | rs2239657 | 0.51 | 0.304581904 | 0.8938 |
| hCV2783620 | rs7021880 | hCV16180474 | rs2273988 | 0.51 | 0.304581904 | 0.3656 |
| hCV2783620 | rs7021880 | hCV16234795 | rs2416804 | 0.51 | 0.304581904 | 0.5724 |
| hCV2783620 | rs7021880 | hCV16234838 | rs2416819 | 0.51 | 0.304581904 | 0.438 |
| hCV2783620 | rs7021880 | hCV16234840 | rs2416817 | 0.51 | 0.304581904 | 0.4634 |
| hCV2783620 | rs7021880 | hCV1632195 | rs1998505 | 0.51 | 0.304581904 | 0.4634 |
| hCV2783620 | rs7021880 | hCV1632205 | rs10818509 | 0.51 | 0.304581904 | 0.388 |
| hCV2783620 | rs7021880 | hCV1761888 | rs1953126 | 0.51 | 0.304581904 | 0.8974 |
| hCV2783620 | rs7021880 | hCV1761891 | rs1930778 | 0.51 | 0.304581904 | 0.919 |
| hCV2783620 | rs7021880 | hCV1761894 | rs1609810 | 0.51 | 0.304581904 | 0.8797 |
| hCV2783620 | rs7021880 | hCV22272588 | rs10760117 | 0.51 | 0.304581904 | 0.3276 |
| hCV2783620 | rs7021880 | hCV2359565 | rs1014530 | 0.51 | 0.304581904 | 0.6088 |
| hCV2783620 | rs7021880 | hCV25472748 | rs10760138 | 0.51 | 0.304581904 | 0.3378 |
| hCV2783620 | rs7021880 | hCV25613469 | rs10760157 | 0.51 | 0.304581904 | 0.438 |
| hCV2783620 | rs7021880 | hCV25746749 | rs7023214 | 0.51 | 0.304581904 | 0.388 |
| hCV2783620 | rs7021880 | hCV25751916 | rs10985070 | 0.51 | 0.304581904 | 0.5878 |
| hCV2783620 | rs7021880 | hCV25771057 | rs10760150 | 0.51 | 0.304581904 | 0.4634 |
| hCV2783620 | rs7021880 | hCV25969661 | rs10818503 | 0.51 | 0.304581904 | 0.388 |
| hCV2783620 | rs7021880 | hCV26144328 | rs4836841 | 0.51 | 0.304581904 | 0.3656 |
| hCV2783620 | rs7021880 | hCV2783582 | rs10818482 | 0.51 | 0.304581904 | 0.5878 |
| hCV2783620 | rs7021880 | hCV2783586 | rs2270231 | 0.51 | 0.304581904 | 0.8974 |
| hCV2783620 | rs7021880 | hCV2783589 | rs881375 | 0.51 | 0.304581904 | 0.8974 |
| hCV2783620 | rs7021880 | hCV2783590 | rs6478486 | 0.51 | 0.304581904 | 0.8974 |
| hCV2783620 | rs7021880 | hCV2783591 | rs1468671 | 0.51 | 0.304581904 | 0.9301 |
| hCV2783620 | rs7021880 | hCV2783593 | rs1548783 | 0.51 | 0.304581904 | 0.9293 |
| hCV2783620 | rs7021880 | hCV2783597 | rs1860824 | 0.51 | 0.304581904 | 0.9627 |
| hCV2783620 | rs7021880 | hCV2783599 | rs7046108 | 0.51 | 0.304581904 | 0.9301 |
| hCV2783620 | rs7021880 | hCV2783604 | rs10760126 | 0.51 | 0.304581904 | 0.6261 |
| hCV2783620 | rs7021880 | hCV2783607 | rs9886724 | 0.51 | 0.304581904 | 0.6151 |
| hCV2783620 | rs7021880 | hCV2783608 | rs4836834 | 0.51 | 0.304581904 | 0.6088 |
| hCV2783620 | rs7021880 | hCV2783609 | rs2241003 | 0.51 | 0.304581904 | 0.8611 |
| hCV2783620 | rs7021880 | hCV2783611 | rs10435843 | 0.51 | 0.304581904 | 0.9301 |
| hCV2783620 | rs7021880 | hCV2783618 | rs2239658 | 0.51 | 0.304581904 | 0.9301 |
| hCV2783620 | rs7021880 | hCV2783621 | rs2416805 | 0.51 | 0.304581904 | 0.9301 |
| hCV2783620 | rs7021880 | hCV2783622 | rs758959 | 0.51 | 0.304581904 | 0.9301 |
| hCV2783620 | rs7021880 | hCV2783625 | rs10118357 | 0.51 | 0.304581904 | 0.6088 |
| hCV2783620 | rs7021880 | hCV2783630 | rs2269060 | 0.51 | 0.304581904 | 0.6088 |
| hCV2783620 | rs7021880 | hCV2783633 | rs7021049 | 0.51 | 0.304581904 | 0.6088 |
| hCV2783620 | rs7021880 | hCV2783634 | rs1014529 | 0.51 | 0.304581904 | 0.9301 |
| hCV2783620 | rs7021880 | hCV2783635 | rs1930780 | 0.51 | 0.304581904 | 0.9301 |
| hCV2783620 | rs7021880 | hCV2783638 | rs3761846 | 0.51 | 0.304581904 | 0.6088 |
| hCV2783620 | rs7021880 | hCV2783640 | rs3761847 | 0.51 | 0.304581904 | 0.5724 |
| hCV2783620 | rs7021880 | hCV2783641 | rs2416806 | 0.51 | 0.304581904 | 0.9275 |
| hCV2783620 | rs7021880 | hCV2783647 | rs10739580 | 0.51 | 0.304581904 | 0.9301 |
| hCV2783620 | rs7021880 | hCV2783650 | rs10760129 | 0.51 | 0.304581904 | 0.6088 |
| hCV2783620 | rs7021880 | hCV2783653 | rs10760130 | 0.51 | 0.304581904 | 0.6088 |
| hCV2783620 | rs7021880 | hCV2783655 | rs10818488 | 0.51 | 0.304581904 | 0.6088 |
| hCV2783620 | rs7021880 | hCV2783656 | rs4837804 | 0.51 | 0.304581904 | 0.8278 |
| hCV2783620 | rs7021880 | hCV2783659 | rs7039505 | 0.51 | 0.304581904 | 0.9186 |
| hCV2783620 | rs7021880 | hCV2783699 | rs10760135 | 0.51 | 0.304581904 | 0.321 |
| hCV2783620 | rs7021880 | hCV2783718 | rs10818500 | 0.51 | 0.304581904 | 0.3411 |
| hCV2783620 | rs7021880 | hCV27912350 | rs4837808 | 0.51 | 0.304581904 | 0.4634 |
| hCV2783620 | rs7021880 | hCV27912351 | rs4837809 | 0.51 | 0.304581904 | 0.4634 |
| hCV2783620 | rs7021880 | hCV29005922 | rs7033790 | 0.51 | 0.304581904 | 0.3506 |
| hCV2783620 | rs7021880 | hCV29005923 | rs6478494 | 0.51 | 0.304581904 | 0.3617 |
| hCV2783620 | rs7021880 | hCV29005924 | rs7031128 | 0.51 | 0.304581904 | 0.3572 |

TABLE 4-continued

| Interrogated SNP | Interrogated rs | LD SNP | LD SNP rs | Power | Threshold r² | r² |
|---|---|---|---|---|---|---|
| hCV2783620 | rs7021880 | hCV29005931 | rs6478496 | 0.51 | 0.304581904 | 0.3506 |
| hCV2783620 | rs7021880 | hCV29005938 | rs7856420 | 0.51 | 0.304581904 | 0.388 |
| hCV2783620 | rs7021880 | hCV29005976 | rs7037195 | 0.51 | 0.304581904 | 0.6088 |
| hCV2783620 | rs7021880 | hCV29005978 | rs7021206 | 0.51 | 0.304581904 | 0.9271 |
| hCV2783620 | rs7021880 | hCV29006006 | rs7034390 | 0.51 | 0.304581904 | 0.8974 |
| hCV2783620 | rs7021880 | hCV30059070 | rs10156413 | 0.51 | 0.304581904 | 0.4923 |
| hCV2783620 | rs7021880 | hCV30293181 | rs10081760 | 0.51 | 0.304581904 | 0.3856 |
| hCV2783620 | rs7021880 | hCV3045792 | rs6478499 | 0.51 | 0.304581904 | 0.4822 |
| hCV2783620 | rs7021880 | hCV3045801 | rs2057465 | 0.51 | 0.304581904 | 0.438 |
| hCV2783620 | rs7021880 | hCV3045802 | rs2057466 | 0.51 | 0.304581904 | 0.3656 |
| hCV2783620 | rs7021880 | hCV3045803 | rs2146836 | 0.51 | 0.304581904 | 0.3656 |
| hCV2783620 | rs7021880 | hCV30527383 | rs9644911 | 0.51 | 0.304581904 | 0.3609 |
| hCV2783620 | rs7021880 | hCV30563728 | rs10156396 | 0.51 | 0.304581904 | 0.3378 |
| hCV2783620 | rs7021880 | hCV30563729 | rs9299273 | 0.51 | 0.304581904 | 0.4634 |
| hCV2783620 | rs7021880 | hCV30830319 | rs7037673 | 0.51 | 0.304581904 | 0.3171 |
| hCV2783620 | rs7021880 | hCV30830339 | rs10818495 | 0.51 | 0.304581904 | 0.3411 |
| hCV2783620 | rs7021880 | hCV30830342 | rs7040319 | 0.51 | 0.304581904 | 0.359 |
| hCV2783620 | rs7021880 | hCV30830395 | rs10985132 | 0.51 | 0.304581904 | 0.3506 |
| hCV2783620 | rs7021880 | hCV30830396 | rs10739584 | 0.51 | 0.304581904 | 0.3193 |
| hCV2783620 | rs7021880 | hCV30830397 | rs10760139 | 0.51 | 0.304581904 | 0.3506 |
| hCV2783620 | rs7021880 | hCV30830406 | rs7040603 | 0.51 | 0.304581904 | 0.3506 |
| hCV2783620 | rs7021880 | hCV30830407 | rs10739585 | 0.51 | 0.304581904 | 0.3506 |
| hCV2783620 | rs7021880 | hCV30830414 | rs7871371 | 0.51 | 0.304581904 | 0.3506 |
| hCV2783620 | rs7021880 | hCV30830417 | rs7029523 | 0.51 | 0.304581904 | 0.3506 |
| hCV2783620 | rs7021880 | hCV30830419 | rs10985140 | 0.51 | 0.304581904 | 0.3342 |
| hCV2783620 | rs7021880 | hCV30830435 | rs10739586 | 0.51 | 0.304581904 | 0.388 |
| hCV2783620 | rs7021880 | hCV30830458 | rs10733651 | 0.51 | 0.304581904 | 0.388 |
| hCV2783620 | rs7021880 | hCV30830468 | rs10818507 | 0.51 | 0.304581904 | 0.388 |
| hCV2783620 | rs7021880 | hCV30830473 | rs7036649 | 0.51 | 0.304581904 | 0.4545 |
| hCV2783620 | rs7021880 | hCV30830475 | rs10733652 | 0.51 | 0.304581904 | 0.3957 |
| hCV2783620 | rs7021880 | hCV30830484 | rs10818508 | 0.51 | 0.304581904 | 0.4634 |
| hCV2783620 | rs7021880 | hCV30830486 | rs10760149 | 0.51 | 0.304581904 | 0.4634 |
| hCV2783620 | rs7021880 | hCV30830503 | rs4837811 | 0.51 | 0.304581904 | 0.4634 |
| hCV2783620 | rs7021880 | hCV30830512 | rs10818512 | 0.51 | 0.304581904 | 0.438 |
| hCV2783620 | rs7021880 | hCV30830521 | rs10818513 | 0.51 | 0.304581904 | 0.438 |
| hCV2783620 | rs7021880 | hCV30830536 | rs7047038 | 0.51 | 0.304581904 | 0.438 |
| hCV2783620 | rs7021880 | hCV30830538 | rs10760152 | 0.51 | 0.304581904 | 0.3778 |
| hCV2783620 | rs7021880 | hCV30830638 | rs10985073 | 0.51 | 0.304581904 | 0.5878 |
| hCV2783620 | rs7021880 | hCV30830725 | rs7864019 | 0.51 | 0.304581904 | 0.9301 |
| hCV2783620 | rs7021880 | hCV30830832 | rs10733648 | 0.51 | 0.304581904 | 0.9301 |
| hCV2783620 | rs7021880 | hCV30830909 | rs11794516 | 0.51 | 0.304581904 | 0.5878 |
| hCV2783620 | rs7021880 | hCV7577250 | rs942153 | 0.51 | 0.304581904 | 0.438 |
| hCV2783620 | rs7021880 | hCV7577271 | rs1535655 | 0.51 | 0.304581904 | 0.438 |
| hCV2783620 | rs7021880 | hCV7577286 | rs1407912 | 0.51 | 0.304581904 | 0.388 |
| hCV2783620 | rs7021880 | hCV7577287 | rs1323478 | 0.51 | 0.304581904 | 0.4634 |
| hCV2783620 | rs7021880 | hCV7577296 | rs1407910 | 0.51 | 0.304581904 | 0.4634 |
| hCV2783620 | rs7021880 | hCV7577311 | rs1323473 | 0.51 | 0.304581904 | 0.3885 |
| hCV2783620 | rs7021880 | hCV7577317 | rs1323472 | 0.51 | 0.304581904 | 0.3511 |
| hCV2783620 | rs7021880 | hCV7577328 | rs1323476 | 0.51 | 0.304581904 | 0.3506 |
| hCV2783620 | rs7021880 | hCV7577331 | rs1468673 | 0.51 | 0.304581904 | 0.3511 |
| hCV2783620 | rs7021880 | hCV7577332 | rs1468672 | 0.51 | 0.304581904 | 0.3506 |
| hCV2783620 | rs7021880 | hCV7577344 | rs876445 | 0.51 | 0.304581904 | 0.9301 |
| hCV2783620 | rs7021880 | hCV782872 | rs758958 | 0.51 | 0.304581904 | 0.3506 |
| hCV2783621 | rs2416805 | hCV11266229 | rs10435844 | 0.51 | 0.411716825 | 1 |
| hCV2783621 | rs2416805 | hCV11266268 | rs10760121 | 0.51 | 0.411716825 | 0.9666 |
| hCV2783621 | rs2416805 | hCV11720350 | rs2057469 | 0.51 | 0.411716825 | 0.4465 |
| hCV2783621 | rs2416805 | hCV11720413 | rs1930782 | 0.51 | 0.411716825 | 0.6687 |
| hCV2783621 | rs2416805 | hCV11720414 | rs1930781 | 0.51 | 0.411716825 | 1 |
| hCV2783621 | rs2416805 | hCV15849105 | rs2900185 | 0.51 | 0.411716825 | 0.4708 |
| hCV2783621 | rs2416805 | hCV15849116 | rs2900180 | 0.51 | 0.411716825 | 1 |
| hCV2783621 | rs2416805 | hCV15870898 | rs2072438 | 0.51 | 0.411716825 | 0.6467 |
| hCV2783621 | rs2416805 | hCV16124825 | rs2109895 | 0.51 | 0.411716825 | 1 |
| hCV2783621 | rs2416805 | hCV16175379 | rs2239657 | 0.51 | 0.411716825 | 0.9664 |
| hCV2783621 | rs2416805 | hCV16234795 | rs2416804 | 0.51 | 0.411716825 | 0.6341 |
| hCV2783621 | rs2416805 | hCV16234838 | rs2416819 | 0.51 | 0.411716825 | 0.4465 |
| hCV2783621 | rs2416805 | hCV16234840 | rs2416817 | 0.51 | 0.411716825 | 0.4708 |
| hCV2783621 | rs2416805 | hCV1632195 | rs1998505 | 0.51 | 0.411716825 | 0.4708 |
| hCV2783621 | rs2416805 | hCV1761888 | rs1953126 | 0.51 | 0.411716825 | 0.9666 |
| hCV2783621 | rs2416805 | hCV1761891 | rs1930778 | 0.51 | 0.411716825 | 0.9602 |
| hCV2783621 | rs2416805 | hCV1761894 | rs1609810 | 0.51 | 0.411716825 | 0.9609 |
| hCV2783621 | rs2416805 | hCV2359565 | rs1014530 | 0.51 | 0.411716825 | 0.6687 |
| hCV2783621 | rs2416805 | hCV25613469 | rs10760157 | 0.51 | 0.411716825 | 0.4465 |
| hCV2783621 | rs2416805 | hCV25751916 | rs10985070 | 0.51 | 0.411716825 | 0.6467 |
| hCV2783621 | rs2416805 | hCV25771057 | rs10760150 | 0.51 | 0.411716825 | 0.4708 |
| hCV2783621 | rs2416805 | hCV2783582 | rs10818482 | 0.51 | 0.411716825 | 0.6467 |
| hCV2783621 | rs2416805 | hCV2783586 | rs2270231 | 0.51 | 0.411716825 | 0.9666 |
| hCV2783621 | rs2416805 | hCV2783589 | rs881375 | 0.51 | 0.411716825 | 0.9666 |

TABLE 4-continued

| Interrogated SNP | Interrogated rs | LD SNP | LD SNP rs | Power | Threshold $r^2$ | $r^2$ |
|---|---|---|---|---|---|---|
| hCV2783621 | rs2416805 | hCV2783590 | rs6478486 | 0.51 | 0.411716825 | 0.9666 |
| hCV2783621 | rs2416805 | hCV2783591 | rs1468671 | 0.51 | 0.411716825 | 1 |
| hCV2783621 | rs2416805 | hCV2783593 | rs1548783 | 0.51 | 0.411716825 | 1 |
| hCV2783621 | rs2416805 | hCV2783597 | rs1860824 | 0.51 | 0.411716825 | 1 |
| hCV2783621 | rs2416805 | hCV2783599 | rs7046108 | 0.51 | 0.411716825 | 1 |
| hCV2783621 | rs2416805 | hCV2783604 | rs10760126 | 0.51 | 0.411716825 | 0.6875 |
| hCV2783621 | rs2416805 | hCV2783607 | rs9886724 | 0.51 | 0.411716825 | 0.6785 |
| hCV2783621 | rs2416805 | hCV2783608 | rs4836834 | 0.51 | 0.411716825 | 0.6687 |
| hCV2783621 | rs2416805 | hCV2783609 | rs2241003 | 0.51 | 0.411716825 | 0.9321 |
| hCV2783621 | rs2416805 | hCV2783611 | rs10435843 | 0.51 | 0.411716825 | 1 |
| hCV2783621 | rs2416805 | hCV2783618 | rs2239658 | 0.51 | 0.411716825 | 1 |
| hCV2783621 | rs2416805 | hCV2783620 | rs7021880 | 0.51 | 0.411716825 | 0.9301 |
| hCV2783621 | rs2416805 | hCV2783622 | rs758959 | 0.51 | 0.411716825 | 1 |
| hCV2783621 | rs2416805 | hCV2783625 | rs10118357 | 0.51 | 0.411716825 | 0.6645 |
| hCV2783621 | rs2416805 | hCV2783630 | rs2269060 | 0.51 | 0.411716825 | 0.6687 |
| hCV2783621 | rs2416805 | hCV2783633 | rs7021049 | 0.51 | 0.411716825 | 0.6687 |
| hCV2783621 | rs2416805 | hCV2783634 | rs1014529 | 0.51 | 0.411716825 | 1 |
| hCV2783621 | rs2416805 | hCV2783635 | rs1930780 | 0.51 | 0.411716825 | 1 |
| hCV2783621 | rs2416805 | hCV2783638 | rs3761846 | 0.51 | 0.411716825 | 0.6687 |
| hCV2783621 | rs2416805 | hCV2783640 | rs3761847 | 0.51 | 0.411716825 | 0.6341 |
| hCV2783621 | rs2416805 | hCV2783641 | rs2416806 | 0.51 | 0.411716825 | 1 |
| hCV2783621 | rs2416805 | hCV2783647 | rs10739580 | 0.51 | 0.411716825 | 1 |
| hCV2783621 | rs2416805 | hCV2783650 | rs10760129 | 0.51 | 0.411716825 | 0.6687 |
| hCV2783621 | rs2416805 | hCV2783653 | rs10760130 | 0.51 | 0.411716825 | 0.6687 |
| hCV2783621 | rs2416805 | hCV2783655 | rs10818488 | 0.51 | 0.411716825 | 0.6687 |
| hCV2783621 | rs2416805 | hCV2783656 | rs4837804 | 0.51 | 0.411716825 | 0.8956 |
| hCV2783621 | rs2416805 | hCV2783659 | rs7039505 | 0.51 | 0.411716825 | 1 |
| hCV2783621 | rs2416805 | hCV27912350 | rs4837808 | 0.51 | 0.411716825 | 0.4708 |
| hCV2783621 | rs2416805 | hCV27912351 | rs4837809 | 0.51 | 0.411716825 | 0.4708 |
| hCV2783621 | rs2416805 | hCV29005923 | rs6478494 | 0.51 | 0.411716825 | 0.4238 |
| hCV2783621 | rs2416805 | hCV29005924 | rs7031128 | 0.51 | 0.411716825 | 0.4264 |
| hCV2783621 | rs2416805 | hCV29005976 | rs7037195 | 0.51 | 0.411716825 | 0.6687 |
| hCV2783621 | rs2416805 | hCV29005978 | rs7021206 | 0.51 | 0.411716825 | 1 |
| hCV2783621 | rs2416805 | hCV29006006 | rs7034390 | 0.51 | 0.411716825 | 0.9666 |
| hCV2783621 | rs2416805 | hCV30059070 | rs10156413 | 0.51 | 0.411716825 | 0.5258 |
| hCV2783621 | rs2416805 | hCV3045792 | rs6478499 | 0.51 | 0.411716825 | 0.4879 |
| hCV2783621 | rs2416805 | hCV3045801 | rs2057465 | 0.51 | 0.411716825 | 0.4332 |
| hCV2783621 | rs2416805 | hCV30563729 | rs9299273 | 0.51 | 0.411716825 | 0.4708 |
| hCV2783621 | rs2416805 | hCV30830414 | rs7871371 | 0.51 | 0.411716825 | 0.417 |
| hCV2783621 | rs2416805 | hCV30830468 | rs10818507 | 0.51 | 0.411716825 | 0.4539 |
| hCV2783621 | rs2416805 | hCV30830473 | rs7036649 | 0.51 | 0.411716825 | 0.4705 |
| hCV2783621 | rs2416805 | hCV30830475 | rs10733652 | 0.51 | 0.411716825 | 0.4269 |
| hCV2783621 | rs2416805 | hCV30830484 | rs10818508 | 0.51 | 0.411716825 | 0.4708 |
| hCV2783621 | rs2416805 | hCV30830486 | rs10760149 | 0.51 | 0.411716825 | 0.4708 |
| hCV2783621 | rs2416805 | hCV30830503 | rs4837811 | 0.51 | 0.411716825 | 0.4708 |
| hCV2783621 | rs2416805 | hCV30830512 | rs10818512 | 0.51 | 0.411716825 | 0.4465 |
| hCV2783621 | rs2416805 | hCV30830521 | rs10818513 | 0.51 | 0.411716825 | 0.4465 |
| hCV2783621 | rs2416805 | hCV30830536 | rs7047038 | 0.51 | 0.411716825 | 0.4465 |
| hCV2783621 | rs2416805 | hCV30830638 | rs10985073 | 0.51 | 0.411716825 | 0.6467 |
| hCV2783621 | rs2416805 | hCV30830725 | rs7864019 | 0.51 | 0.411716825 | 1 |
| hCV2783621 | rs2416805 | hCV30830832 | rs10733648 | 0.51 | 0.411716825 | 1 |
| hCV2783621 | rs2416805 | hCV30830909 | rs11794516 | 0.51 | 0.411716825 | 0.6467 |
| hCV2783621 | rs2416805 | hCV7577250 | rs942153 | 0.51 | 0.411716825 | 0.4465 |
| hCV2783621 | rs2416805 | hCV7577271 | rs1535655 | 0.51 | 0.411716825 | 0.4465 |
| hCV2783621 | rs2416805 | hCV7577287 | rs1323478 | 0.51 | 0.411716825 | 0.4708 |
| hCV2783621 | rs2416805 | hCV7577296 | rs1407910 | 0.51 | 0.411716825 | 0.4708 |
| hCV2783621 | rs2416805 | hCV7577344 | rs876445 | 0.51 | 0.411716825 | 1 |
| hCV2783625 | rs10118357 | hCV11266229 | rs10435844 | 0.51 | 0.313879134 | 0.6645 |
| hCV2783625 | rs10118357 | hCV11266268 | rs10760121 | 0.51 | 0.313879134 | 0.6295 |
| hCV2783625 | rs10118357 | hCV11720351 | rs1885995 | 0.51 | 0.313879134 | 0.4886 |
| hCV2783625 | rs10118357 | hCV11720402 | rs17611 | 0.51 | 0.313879134 | 0.3377 |
| hCV2783625 | rs10118357 | hCV11720413 | rs1930782 | 0.51 | 0.313879134 | 1 |
| hCV2783625 | rs10118357 | hCV11720414 | rs1930781 | 0.51 | 0.313879134 | 0.6645 |
| hCV2783625 | rs10118357 | hCV1452630 | rs10818476 | 0.51 | 0.313879134 | 0.3662 |
| hCV2783625 | rs10118357 | hCV1452651 | rs3793638 | 0.51 | 0.313879134 | 0.3446 |
| hCV2783625 | rs10118357 | hCV1452652 | rs1060817 | 0.51 | 0.313879134 | 0.3446 |
| hCV2783625 | rs10118357 | hCV1452665 | rs4837796 | 0.51 | 0.313879134 | 0.3662 |
| hCV2783625 | rs10118357 | hCV15751717 | rs2296077 | 0.51 | 0.313879134 | 0.4287 |
| hCV2783625 | rs10118357 | hCV15751719 | rs2146838 | 0.51 | 0.313879134 | 0.4886 |
| hCV2783625 | rs10118357 | hCV15755658 | rs2300934 | 0.51 | 0.313879134 | 0.3203 |
| hCV2783625 | rs10118357 | hCV15757738 | rs2302498 | 0.51 | 0.313879134 | 0.4424 |
| hCV2783625 | rs10118357 | hCV15849116 | rs2900180 | 0.51 | 0.313879134 | 0.6587 |
| hCV2783625 | rs10118357 | hCV15870898 | rs2072438 | 0.51 | 0.313879134 | 0.9665 |
| hCV2783625 | rs10118357 | hCV16124825 | rs2109895 | 0.51 | 0.313879134 | 0.6645 |
| hCV2783625 | rs10118357 | hCV16175379 | rs2239657 | 0.51 | 0.313879134 | 0.6419 |
| hCV2783625 | rs10118357 | hCV16234785 | rs2416811 | 0.51 | 0.313879134 | 0.3377 |
| hCV2783625 | rs10118357 | hCV16234795 | rs2416804 | 0.51 | 0.313879134 | 0.9666 |

TABLE 4-continued

| Interrogated SNP | Interrogated rs | LD SNP | LD SNP rs | Power | Threshold r² | r² |
|---|---|---|---|---|---|---|
| hCV2783625 | rs10118357 | hCV1761881 | rs3933326 | 0.51 | 0.313879134 | 0.3184 |
| hCV2783625 | rs10118357 | hCV1761888 | rs1953126 | 0.51 | 0.313879134 | 0.6295 |
| hCV2783625 | rs10118357 | hCV1761891 | rs1930778 | 0.51 | 0.313879134 | 0.5712 |
| hCV2783625 | rs10118357 | hCV1761894 | rs1609810 | 0.51 | 0.313879134 | 0.6003 |
| hCV2783625 | rs10118357 | hCV22272588 | rs10760117 | 0.51 | 0.313879134 | 0.3662 |
| hCV2783625 | rs10118357 | hCV2359565 | rs1014530 | 0.51 | 0.313879134 | 1 |
| hCV2783625 | rs10118357 | hCV2359571 | rs25681 | 0.51 | 0.313879134 | 0.3377 |
| hCV2783625 | rs10118357 | hCV25751916 | rs10985070 | 0.51 | 0.313879134 | 0.9665 |
| hCV2783625 | rs10118357 | hCV26144282 | rs10818499 | 0.51 | 0.313879134 | 0.3377 |
| hCV2783625 | rs10118357 | hCV26144291 | rs4570235 | 0.51 | 0.313879134 | 0.3377 |
| hCV2783625 | rs10118357 | hCV26144307 | rs1016468 | 0.51 | 0.313879134 | 0.4886 |
| hCV2783625 | rs10118357 | hCV26144332 | rs4837813 | 0.51 | 0.313879134 | 0.4683 |
| hCV2783625 | rs10118357 | hCV2783582 | rs10818482 | 0.51 | 0.313879134 | 0.9665 |
| hCV2783625 | rs10118357 | hCV2783586 | rs2270231 | 0.51 | 0.313879134 | 0.6295 |
| hCV2783625 | rs10118357 | hCV2783589 | rs881375 | 0.51 | 0.313879134 | 0.6295 |
| hCV2783625 | rs10118357 | hCV2783590 | rs6478486 | 0.51 | 0.313879134 | 0.6295 |
| hCV2783625 | rs10118357 | hCV2783591 | rs1468671 | 0.51 | 0.313879134 | 0.6645 |
| hCV2783625 | rs10118357 | hCV2783593 | rs1548783 | 0.51 | 0.313879134 | 0.6601 |
| hCV2783625 | rs10118357 | hCV2783597 | rs1860824 | 0.51 | 0.313879134 | 0.6539 |
| hCV2783625 | rs10118357 | hCV2783599 | rs7046108 | 0.51 | 0.313879134 | 0.6645 |
| hCV2783625 | rs10118357 | hCV2783604 | rs10760126 | 0.51 | 0.313879134 | 1 |
| hCV2783625 | rs10118357 | hCV2783607 | rs9886724 | 0.51 | 0.313879134 | 1 |
| hCV2783625 | rs10118357 | hCV2783608 | rs4836834 | 0.51 | 0.313879134 | 1 |
| hCV2783625 | rs10118357 | hCV2783609 | rs2241003 | 0.51 | 0.313879134 | 0.7034 |
| hCV2783625 | rs10118357 | hCV2783611 | rs10435843 | 0.51 | 0.313879134 | 0.6645 |
| hCV2783625 | rs10118357 | hCV2783618 | rs2239658 | 0.51 | 0.313879134 | 0.6645 |
| hCV2783625 | rs10118357 | hCV2783620 | rs7021880 | 0.51 | 0.313879134 | 0.6088 |
| hCV2783625 | rs10118357 | hCV2783621 | rs2416805 | 0.51 | 0.313879134 | 0.6645 |
| hCV2783625 | rs10118357 | hCV2783622 | rs758959 | 0.51 | 0.313879134 | 0.6645 |
| hCV2783625 | rs10118357 | hCV2783630 | rs2269060 | 0.51 | 0.313879134 | 1 |
| hCV2783625 | rs10118357 | hCV2783633 | rs7021049 | 0.51 | 0.313879134 | 1 |
| hCV2783625 | rs10118357 | hCV2783634 | rs1014529 | 0.51 | 0.313879134 | 0.6645 |
| hCV2783625 | rs10118357 | hCV2783635 | rs1930780 | 0.51 | 0.313879134 | 0.6645 |
| hCV2783625 | rs10118357 | hCV2783638 | rs3761846 | 0.51 | 0.313879134 | 1 |
| hCV2783625 | rs10118357 | hCV2783640 | rs3761847 | 0.51 | 0.313879134 | 0.9666 |
| hCV2783625 | rs10118357 | hCV2783641 | rs2416806 | 0.51 | 0.313879134 | 0.655 |
| hCV2783625 | rs10118357 | hCV2783647 | rs10739580 | 0.51 | 0.313879134 | 0.6645 |
| hCV2783625 | rs10118357 | hCV2783650 | rs10760129 | 0.51 | 0.313879134 | 1 |
| hCV2783625 | rs10118357 | hCV2783653 | rs10760130 | 0.51 | 0.313879134 | 1 |
| hCV2783625 | rs10118357 | hCV2783655 | rs10818488 | 0.51 | 0.313879134 | 1 |
| hCV2783625 | rs10118357 | hCV2783656 | rs4837804 | 0.51 | 0.313879134 | 0.775 |
| hCV2783625 | rs10118357 | hCV2783659 | rs7039505 | 0.51 | 0.313879134 | 0.6519 |
| hCV2783625 | rs10118357 | hCV2783711 | rs10733650 | 0.51 | 0.313879134 | 0.3812 |
| hCV2783625 | rs10118357 | hCV2783718 | rs10818500 | 0.51 | 0.313879134 | 0.6661 |
| hCV2783625 | rs10118357 | hCV29005933 | rs7042135 | 0.51 | 0.313879134 | 0.3203 |
| hCV2783625 | rs10118357 | hCV29005936 | rs6478498 | 0.51 | 0.313879134 | 0.3203 |
| hCV2783625 | rs10118357 | hCV29005955 | rs7036980 | 0.51 | 0.313879134 | 0.4221 |
| hCV2783625 | rs10118357 | hCV29005976 | rs7037195 | 0.51 | 0.313879134 | 1 |
| hCV2783625 | rs10118357 | hCV29005978 | rs7021206 | 0.51 | 0.313879134 | 0.6989 |
| hCV2783625 | rs10118357 | hCV29006006 | rs7034390 | 0.51 | 0.313879134 | 0.6295 |
| hCV2783625 | rs10118357 | hCV29734592 | rs10435889 | 0.51 | 0.313879134 | 0.3247 |
| hCV2783625 | rs10118357 | hCV29879049 | rs9792437 | 0.51 | 0.313879134 | 0.4631 |
| hCV2783625 | rs10118357 | hCV3045812 | rs7030849 | 0.51 | 0.313879134 | 0.4631 |
| hCV2783625 | rs10118357 | hCV30829523 | rs12343516 | 0.51 | 0.313879134 | 0.3446 |
| hCV2783625 | rs10118357 | hCV30830319 | rs7037673 | 0.51 | 0.313879134 | 0.5292 |
| hCV2783625 | rs10118357 | hCV30830325 | rs10818494 | 0.51 | 0.313879134 | 0.4255 |
| hCV2783625 | rs10118357 | hCV30830340 | rs10760134 | 0.51 | 0.313879134 | 0.4048 |
| hCV2783625 | rs10118357 | hCV30830341 | rs7040033 | 0.51 | 0.313879134 | 0.4048 |
| hCV2783625 | rs10118357 | hCV30830415 | rs7855998 | 0.51 | 0.313879134 | 0.3203 |
| hCV2783625 | rs10118357 | hCV30830419 | rs10985140 | 0.51 | 0.313879134 | 0.6251 |
| hCV2783625 | rs10118357 | hCV30830427 | rs10760142 | 0.51 | 0.313879134 | 0.3203 |
| hCV2783625 | rs10118357 | hCV30830474 | rs10739590 | 0.51 | 0.313879134 | 0.5432 |
| hCV2783625 | rs10118357 | hCV30830638 | rs10985073 | 0.51 | 0.313879134 | 0.9665 |
| hCV2783625 | rs10118357 | hCV30830725 | rs7864019 | 0.51 | 0.313879134 | 0.6645 |
| hCV2783625 | rs10118357 | hCV30830832 | rs10733648 | 0.51 | 0.313879134 | 0.6645 |
| hCV2783625 | rs10118357 | hCV30830909 | rs11794516 | 0.51 | 0.313879134 | 0.9665 |
| hCV2783625 | rs10118357 | hCV7577254 | rs942152 | 0.51 | 0.313879134 | 0.393 |
| hCV2783625 | rs10118357 | hCV7577317 | rs1323472 | 0.51 | 0.313879134 | 0.6544 |
| hCV2783625 | rs10118357 | hCV7577331 | rs1468673 | 0.51 | 0.313879134 | 0.6544 |
| hCV2783625 | rs10118357 | hCV7577337 | rs993247 | 0.51 | 0.313879134 | 0.3377 |
| hCV2783625 | rs10118357 | hCV7577344 | rs876445 | 0.51 | 0.313879134 | 0.6645 |
| hCV2783625 | rs10118357 | hCV782875 | rs746182 | 0.51 | 0.313879134 | 0.4683 |
| hCV2783633 | rs7021049 | hCV11266229 | rs10435844 | 0.51 | 0.313879134 | 0.6687 |
| hCV2783633 | rs7021049 | hCV11266268 | rs10760121 | 0.51 | 0.313879134 | 0.6344 |
| hCV2783633 | rs7021049 | hCV11720351 | rs1885995 | 0.51 | 0.313879134 | 0.472 |
| hCV2783633 | rs7021049 | hCV11720402 | rs17611 | 0.51 | 0.313879134 | 0.3301 |
| hCV2783633 | rs7021049 | hCV11720413 | rs1930782 | 0.51 | 0.313879134 | 1 |

TABLE 4-continued

| Interrogated SNP | Interrogated rs | LD SNP | LD SNP rs | Power | Threshold r² | r² |
|---|---|---|---|---|---|---|
| hCV2783633 | rs7021049 | hCV11720414 | rs1930781 | 0.51 | 0.313879134 | 0.6687 |
| hCV2783633 | rs7021049 | hCV1452630 | rs10818476 | 0.51 | 0.313879134 | 0.3495 |
| hCV2783633 | rs7021049 | hCV1452651 | rs3793638 | 0.51 | 0.313879134 | 0.3281 |
| hCV2783633 | rs7021049 | hCV1452652 | rs1060817 | 0.51 | 0.313879134 | 0.3281 |
| hCV2783633 | rs7021049 | hCV1452665 | rs4837796 | 0.51 | 0.313879134 | 0.3495 |
| hCV2783633 | rs7021049 | hCV15751717 | rs2296077 | 0.51 | 0.313879134 | 0.4129 |
| hCV2783633 | rs7021049 | hCV15751719 | rs2146838 | 0.51 | 0.313879134 | 0.472 |
| hCV2783633 | rs7021049 | hCV15757738 | rs2302498 | 0.51 | 0.313879134 | 0.4266 |
| hCV2783633 | rs7021049 | hCV15849116 | rs2900180 | 0.51 | 0.313879134 | 0.6587 |
| hCV2783633 | rs7021049 | hCV15870898 | rs2072438 | 0.51 | 0.313879134 | 0.9671 |
| hCV2783633 | rs7021049 | hCV16124825 | rs2109895 | 0.51 | 0.313879134 | 0.6687 |
| hCV2783633 | rs7021049 | hCV16175379 | rs2239657 | 0.51 | 0.313879134 | 0.6463 |
| hCV2783633 | rs7021049 | hCV16234785 | rs2416811 | 0.51 | 0.313879134 | 0.3301 |
| hCV2783633 | rs7021049 | hCV16234795 | rs2416804 | 0.51 | 0.313879134 | 0.9672 |
| hCV2783633 | rs7021049 | hCV1761881 | rs3933326 | 0.51 | 0.313879134 | 0.3254 |
| hCV2783633 | rs7021049 | hCV1761888 | rs1953126 | 0.51 | 0.313879134 | 0.6344 |
| hCV2783633 | rs7021049 | hCV1761891 | rs1930778 | 0.51 | 0.313879134 | 0.5775 |
| hCV2783633 | rs7021049 | hCV1761894 | rs1609810 | 0.51 | 0.313879134 | 0.6088 |
| hCV2783633 | rs7021049 | hCV22272588 | rs10760117 | 0.51 | 0.313879134 | 0.3495 |
| hCV2783633 | rs7021049 | hCV2359565 | rs1014530 | 0.51 | 0.313879134 | 1 |
| hCV2783633 | rs7021049 | hCV2359571 | rs25681 | 0.51 | 0.313879134 | 0.3301 |
| hCV2783633 | rs7021049 | hCV25751916 | rs10985070 | 0.51 | 0.313879134 | 0.9671 |
| hCV2783633 | rs7021049 | hCV26144282 | rs10818499 | 0.51 | 0.313879134 | 0.3301 |
| hCV2783633 | rs7021049 | hCV26144291 | rs4570235 | 0.51 | 0.313879134 | 0.3301 |
| hCV2783633 | rs7021049 | hCV26144307 | rs1016468 | 0.51 | 0.313879134 | 0.472 |
| hCV2783633 | rs7021049 | hCV26144332 | rs4837813 | 0.51 | 0.313879134 | 0.4513 |
| hCV2783633 | rs7021049 | hCV2783582 | rs10818482 | 0.51 | 0.313879134 | 0.9671 |
| hCV2783633 | rs7021049 | hCV2783586 | rs2270231 | 0.51 | 0.313879134 | 0.6344 |
| hCV2783633 | rs7021049 | hCV2783589 | rs881375 | 0.51 | 0.313879134 | 0.6344 |
| hCV2783633 | rs7021049 | hCV2783590 | rs6478486 | 0.51 | 0.313879134 | 0.6344 |
| hCV2783633 | rs7021049 | hCV2783591 | rs1468671 | 0.51 | 0.313879134 | 0.6687 |
| hCV2783633 | rs7021049 | hCV2783593 | rs1548783 | 0.51 | 0.313879134 | 0.6645 |
| hCV2783633 | rs7021049 | hCV2783597 | rs1860824 | 0.51 | 0.313879134 | 0.6581 |
| hCV2783633 | rs7021049 | hCV2783599 | rs7046108 | 0.51 | 0.313879134 | 0.6687 |
| hCV2783633 | rs7021049 | hCV2783604 | rs10760126 | 0.51 | 0.313879134 | 1 |
| hCV2783633 | rs7021049 | hCV2783607 | rs9886724 | 0.51 | 0.313879134 | 1 |
| hCV2783633 | rs7021049 | hCV2783608 | rs4836834 | 0.51 | 0.313879134 | 1 |
| hCV2783633 | rs7021049 | hCV2783609 | rs2241003 | 0.51 | 0.313879134 | 0.7074 |
| hCV2783633 | rs7021049 | hCV2783611 | rs10435843 | 0.51 | 0.313879134 | 0.6687 |
| hCV2783633 | rs7021049 | hCV2783618 | rs2239658 | 0.51 | 0.313879134 | 0.6687 |
| hCV2783633 | rs7021049 | hCV2783620 | rs7021880 | 0.51 | 0.313879134 | 0.6088 |
| hCV2783633 | rs7021049 | hCV2783621 | rs2416805 | 0.51 | 0.313879134 | 0.6687 |
| hCV2783633 | rs7021049 | hCV2783622 | rs758959 | 0.51 | 0.313879134 | 0.6687 |
| hCV2783633 | rs7021049 | hCV2783625 | rs10118357 | 0.51 | 0.313879134 | 1 |
| hCV2783633 | rs7021049 | hCV2783630 | rs2269060 | 0.51 | 0.313879134 | 1 |
| hCV2783633 | rs7021049 | hCV2783634 | rs1014529 | 0.51 | 0.313879134 | 0.6687 |
| hCV2783633 | rs7021049 | hCV2783635 | rs1930780 | 0.51 | 0.313879134 | 0.6687 |
| hCV2783633 | rs7021049 | hCV2783638 | rs3761846 | 0.51 | 0.313879134 | 1 |
| hCV2783633 | rs7021049 | hCV2783640 | rs3761847 | 0.51 | 0.313879134 | 0.9672 |
| hCV2783633 | rs7021049 | hCV2783641 | rs2416806 | 0.51 | 0.313879134 | 0.6594 |
| hCV2783633 | rs7021049 | hCV2783647 | rs10739580 | 0.51 | 0.313879134 | 0.6687 |
| hCV2783633 | rs7021049 | hCV2783650 | rs10760129 | 0.51 | 0.313879134 | 1 |
| hCV2783633 | rs7021049 | hCV2783653 | rs10760130 | 0.51 | 0.313879134 | 1 |
| hCV2783633 | rs7021049 | hCV2783655 | rs10818488 | 0.51 | 0.313879134 | 1 |
| hCV2783633 | rs7021049 | hCV2783656 | rs4837804 | 0.51 | 0.313879134 | 0.775 |
| hCV2783633 | rs7021049 | hCV2783659 | rs7039505 | 0.51 | 0.313879134 | 0.6562 |
| hCV2783633 | rs7021049 | hCV2783711 | rs10733650 | 0.51 | 0.313879134 | 0.3723 |
| hCV2783633 | rs7021049 | hCV2783718 | rs10818500 | 0.51 | 0.313879134 | 0.6661 |
| hCV2783633 | rs7021049 | hCV29005955 | rs7036980 | 0.51 | 0.313879134 | 0.4056 |
| hCV2783633 | rs7021049 | hCV29005976 | rs7037195 | 0.51 | 0.313879134 | 1 |
| hCV2783633 | rs7021049 | hCV29005978 | rs7021206 | 0.51 | 0.313879134 | 0.7031 |
| hCV2783633 | rs7021049 | hCV29006006 | rs7034390 | 0.51 | 0.313879134 | 0.6344 |
| hCV2783633 | rs7021049 | hCV29734592 | rs10435889 | 0.51 | 0.313879134 | 0.3176 |
| hCV2783633 | rs7021049 | hCV29879049 | rs9792437 | 0.51 | 0.313879134 | 0.4468 |
| hCV2783633 | rs7021049 | hCV3045812 | rs7030849 | 0.51 | 0.313879134 | 0.4468 |
| hCV2783633 | rs7021049 | hCV30829523 | rs12343516 | 0.51 | 0.313879134 | 0.3281 |
| hCV2783633 | rs7021049 | hCV30830319 | rs7037673 | 0.51 | 0.313879134 | 0.517 |
| hCV2783633 | rs7021049 | hCV30830325 | rs10818494 | 0.51 | 0.313879134 | 0.4154 |
| hCV2783633 | rs7021049 | hCV30830340 | rs10760134 | 0.51 | 0.313879134 | 0.3949 |
| hCV2783633 | rs7021049 | hCV30830341 | rs7040033 | 0.51 | 0.313879134 | 0.3949 |
| hCV2783633 | rs7021049 | hCV30830419 | rs10985140 | 0.51 | 0.313879134 | 0.6317 |
| hCV2783633 | rs7021049 | hCV30830474 | rs10739590 | 0.51 | 0.313879134 | 0.5169 |
| hCV2783633 | rs7021049 | hCV30830638 | rs10985073 | 0.51 | 0.313879134 | 0.9671 |
| hCV2783633 | rs7021049 | hCV30830725 | rs7864019 | 0.51 | 0.313879134 | 0.6687 |
| hCV2783633 | rs7021049 | hCV30830832 | rs10733648 | 0.51 | 0.313879134 | 0.6687 |
| hCV2783633 | rs7021049 | hCV30830909 | rs11794516 | 0.51 | 0.313879134 | 0.9671 |
| hCV2783633 | rs7021049 | hCV7577254 | rs942152 | 0.51 | 0.313879134 | 0.3797 |

TABLE 4-continued

| Interrogated SNP | Interrogated rs | LD SNP | LD SNP rs | Power | Threshold r² | r² |
|---|---|---|---|---|---|---|
| hCV2783633 | rs7021049 | hCV7577317 | rs1323472 | 0.51 | 0.313879134 | 0.6604 |
| hCV2783633 | rs7021049 | hCV7577331 | rs1468673 | 0.51 | 0.313879134 | 0.6604 |
| hCV2783633 | rs7021049 | hCV7577337 | rs993247 | 0.51 | 0.313879134 | 0.3301 |
| hCV2783633 | rs7021049 | hCV7577344 | rs876445 | 0.51 | 0.313879134 | 0.6687 |
| hCV2783633 | rs7021049 | hCV782875 | rs746182 | 0.51 | 0.313879134 | 0.4513 |
| hCV2783634 | rs10435829 | hCV11266229 | rs10435844 | 0.51 | 0.411716825 | 1 |
| hCV2783634 | rs1014529 | hCV11266268 | rs10760121 | 0.51 | 0.411716825 | 0.9666 |
| hCV2783634 | rs1014529 | hCV11720350 | rs2057469 | 0.51 | 0.411716825 | 0.4465 |
| hCV2783634 | rs1014529 | hCV11720413 | rs1930782 | 0.51 | 0.411716825 | 0.6687 |
| hCV2783634 | rs1014529 | hCV11720414 | rs1930781 | 0.51 | 0.411716825 | 1 |
| hCV2783634 | rs1014529 | hCV15849105 | rs2900185 | 0.51 | 0.411716825 | 0.4708 |
| hCV2783634 | rs1014529 | hCV15849116 | rs2900180 | 0.51 | 0.411716825 | 1 |
| hCV2783634 | rs1014529 | hCV15870898 | rs2072438 | 0.51 | 0.411716825 | 0.6467 |
| hCV2783634 | rs1014529 | hCV16124825 | rs2109895 | 0.51 | 0.411716825 | 1 |
| hCV2783634 | rs1014529 | hCV16175379 | rs2239657 | 0.51 | 0.411716825 | 0.9664 |
| hCV2783634 | rs1014529 | hCV16234795 | rs2416804 | 0.51 | 0.411716825 | 0.6341 |
| hCV2783634 | rs1014529 | hCV16234838 | rs2416819 | 0.51 | 0.411716825 | 0.4465 |
| hCV2783634 | rs1014529 | hCV16234840 | rs2416817 | 0.51 | 0.411716825 | 0.4708 |
| hCV2783634 | rs1014529 | hCV1632195 | rs1998505 | 0.51 | 0.411716825 | 0.4708 |
| hCV2783634 | rs1014529 | hCV1761888 | rs1953126 | 0.51 | 0.411716825 | 0.9666 |
| hCV2783634 | rs1014529 | hCV1761891 | rs1930778 | 0.51 | 0.411716825 | 0.9602 |
| hCV2783634 | rs1014529 | hCV1761894 | rs1609810 | 0.51 | 0.411716825 | 0.9609 |
| hCV2783634 | rs1014529 | hCV2359565 | rs1014530 | 0.51 | 0.411716825 | 0.6687 |
| hCV2783634 | rs1014529 | hCV25613469 | rs10760157 | 0.51 | 0.411716825 | 0.4465 |
| hCV2783634 | rs1014529 | hCV25751916 | rs10985070 | 0.51 | 0.411716825 | 0.6467 |
| hCV2783634 | rs1014529 | hCV25771057 | rs10760150 | 0.51 | 0.411716825 | 0.4708 |
| hCV2783634 | rs1014529 | hCV2783582 | rs10818482 | 0.51 | 0.411716825 | 0.6467 |
| hCV2783634 | rs1014529 | hCV2783586 | rs2270231 | 0.51 | 0.411716825 | 0.9666 |
| hCV2783634 | rs1014529 | hCV2783589 | rs881375 | 0.51 | 0.411716825 | 0.9666 |
| hCV2783634 | rs1014529 | hCV2783590 | rs6478486 | 0.51 | 0.411716825 | 0.9666 |
| hCV2783634 | rs1014529 | hCV2783591 | rs1468671 | 0.51 | 0.411716825 | 1 |
| hCV2783634 | rs1014529 | hCV2783593 | rs1548783 | 0.51 | 0.411716825 | 1 |
| hCV2783634 | rs1014529 | hCV2783597 | rs1860824 | 0.51 | 0.411716825 | 1 |
| hCV2783634 | rs1014529 | hCV2783599 | rs7046108 | 0.51 | 0.411716825 | 1 |
| hCV2783634 | rs1014529 | hCV2783604 | rs10760126 | 0.51 | 0.411716825 | 0.6875 |
| hCV2783634 | rs1014529 | hCV2783607 | rs9886724 | 0.51 | 0.411716825 | 0.6785 |
| hCV2783634 | rs1014529 | hCV2783608 | rs4836834 | 0.51 | 0.411716825 | 0.6687 |
| hCV2783634 | rs1014529 | hCV2783609 | rs2241003 | 0.51 | 0.411716825 | 0.9321 |
| hCV2783634 | rs1014529 | hCV2783611 | rs10435843 | 0.51 | 0.411716825 | 1 |
| hCV2783634 | rs1014529 | hCV2783618 | rs2239658 | 0.51 | 0.411716825 | 1 |
| hCV2783634 | rs1014529 | hCV2783620 | rs7021880 | 0.51 | 0.411716825 | 0.9301 |
| hCV2783634 | rs1014529 | hCV2783621 | rs2416805 | 0.51 | 0.411716825 | 1 |
| hCV2783634 | rs1014529 | hCV2783622 | rs758959 | 0.51 | 0.411716825 | 1 |
| hCV2783634 | rs1014529 | hCV2783625 | rs10118357 | 0.51 | 0.411716825 | 0.6645 |
| hCV2783634 | rs1014529 | hCV2783630 | rs2269060 | 0.51 | 0.411716825 | 0.6687 |
| hCV2783634 | rs1014529 | hCV2783633 | rs7021049 | 0.51 | 0.411716825 | 0.6687 |
| hCV2783634 | rs1014529 | hCV2783635 | rs1930780 | 0.51 | 0.411716825 | 1 |
| hCV2783634 | rs1014529 | hCV2783638 | rs3761846 | 0.51 | 0.411716825 | 0.6687 |
| hCV2783634 | rs1014529 | hCV2783640 | rs3761847 | 0.51 | 0.411716825 | 0.6341 |
| hCV2783634 | rs1014529 | hCV2783641 | rs2416806 | 0.51 | 0.411716825 | 1 |
| hCV2783634 | rs1014529 | hCV2783647 | rs10739580 | 0.51 | 0.411716825 | 1 |
| hCV2783634 | rs1014529 | hCV2783650 | rs10760129 | 0.51 | 0.411716825 | 0.6687 |
| hCV2783634 | rs1014529 | hCV2783653 | rs10760130 | 0.51 | 0.411716825 | 0.6687 |
| hCV2783634 | rs1014529 | hCV2783655 | rs10818488 | 0.51 | 0.411716825 | 0.6687 |
| hCV2783634 | rs1014529 | hCV2783656 | rs4837804 | 0.51 | 0.411716825 | 0.8956 |
| hCV2783634 | rs1014529 | hCV2783659 | rs7039505 | 0.51 | 0.411716825 | 1 |
| hCV2783634 | rs1014529 | hCV27912350 | rs4837808 | 0.51 | 0.411716825 | 0.4708 |
| hCV2783634 | rs1014529 | hCV27912351 | rs4837809 | 0.51 | 0.411716825 | 0.4708 |
| hCV2783634 | rs1014529 | hCV29005923 | rs6478494 | 0.51 | 0.411716825 | 0.4238 |
| hCV2783634 | rs1014529 | hCV29005924 | rs7031128 | 0.51 | 0.411716825 | 0.4264 |
| hCV2783634 | rs1014529 | hCV29005976 | rs7037195 | 0.51 | 0.411716825 | 0.6687 |
| hCV2783634 | rs1014529 | hCV29005978 | rs7021206 | 0.51 | 0.411716825 | 1 |
| hCV2783634 | rs1014529 | hCV29006006 | rs7034390 | 0.51 | 0.411716825 | 0.9666 |
| hCV2783634 | rs1014529 | hCV30059070 | rs10156413 | 0.51 | 0.411716825 | 0.5258 |
| hCV2783634 | rs1014529 | hCV3045792 | rs6478499 | 0.51 | 0.411716825 | 0.4879 |
| hCV2783634 | rs1014529 | hCV3045801 | rs2057465 | 0.51 | 0.411716825 | 0.4332 |
| hCV2783634 | rs1014529 | hCV30563729 | rs9299273 | 0.51 | 0.411716825 | 0.4708 |
| hCV2783634 | rs1014529 | hCV30830414 | rs7871371 | 0.51 | 0.411716825 | 0.417 |
| hCV2783634 | rs1014529 | hCV30830468 | rs10818507 | 0.51 | 0.411716825 | 0.4539 |
| hCV2783634 | rs1014529 | hCV30830473 | rs7036649 | 0.51 | 0.411716825 | 0.4705 |
| hCV2783634 | rs1014529 | hCV30830475 | rs10733652 | 0.51 | 0.411716825 | 0.4269 |
| hCV2783634 | rs1014529 | hCV30830484 | rs10818508 | 0.51 | 0.411716825 | 0.4708 |
| hCV2783634 | rs1014529 | hCV30830486 | rs10760149 | 0.51 | 0.411716825 | 0.4708 |
| hCV2783634 | rs1014529 | hCV30830503 | rs4837811 | 0.51 | 0.411716825 | 0.4708 |
| hCV2783634 | rs1014529 | hCV30830512 | rs10818512 | 0.51 | 0.411716825 | 0.4465 |
| hCV2783634 | rs1014529 | hCV30830521 | rs10818513 | 0.51 | 0.411716825 | 0.4465 |
| hCV2783634 | rs1014529 | hCV30830536 | rs7047038 | 0.51 | 0.411716825 | 0.4465 |

TABLE 4-continued

| Interrogated SNP | Interrogated rs | LD SNP | LD SNP rs | Power | Threshold $r^2$ | $r^2$ |
|---|---|---|---|---|---|---|
| hCV2783634 | rs1014529 | hCV30830638 | rs10985073 | 0.51 | 0.411716825 | 0.6467 |
| hCV2783634 | rs1014529 | hCV30830725 | rs7864029 | 0.51 | 0.411716825 | 1 |
| hCV2783634 | rs1014529 | hCV30830832 | rs10733648 | 0.51 | 0.411716825 | 1 |
| hCV2783634 | rs1014529 | hCV30830909 | rs11794516 | 0.51 | 0.411716825 | 0.6467 |
| hCV2783634 | rs1014529 | hCV7577250 | rs942153 | 0.51 | 0.411716825 | 0.4465 |
| hCV2783634 | rs1014529 | hCV7577271 | rs1535655 | 0.51 | 0.411716825 | 0.4465 |
| hCV2783634 | rs1014529 | hCV7577287 | rs1323478 | 0.51 | 0.411716825 | 0.4708 |
| hCV2783634 | rs1014529 | hCV7577296 | rs1407910 | 0.51 | 0.411716825 | 0.4708 |
| hCV2783634 | rs1014529 | hCV7577344 | rs876445 | 0.51 | 0.411716825 | 1 |
| hCV2783638 | rs3761846 | hCV11266229 | rs10435844 | 0.51 | 0.329406037 | 0.6687 |
| hCV2783638 | rs3761846 | hCV11266268 | rs10760121 | 0.51 | 0.329406037 | 0.6344 |
| hCV2783638 | rs3761846 | hCV11720351 | rs1885995 | 0.51 | 0.329406037 | 0.472 |
| hCV2783638 | rs3761846 | hCV11720402 | rs17611 | 0.51 | 0.329406037 | 0.3301 |
| hCV2783638 | rs3761846 | hCV11720413 | rs1930782 | 0.51 | 0.329406037 | 1 |
| hCV2783638 | rs3761846 | hCV11720414 | rs1930781 | 0.51 | 0.329406037 | 0.6687 |
| hCV2783638 | rs3761846 | hCV1452630 | rs10818476 | 0.51 | 0.329406037 | 0.3495 |
| hCV2783638 | rs3761846 | hCV1452665 | rs4837796 | 0.51 | 0.329406037 | 0.3495 |
| hCV2783638 | rs3761846 | hCV15751717 | rs2296077 | 0.51 | 0.329406037 | 0.4129 |
| hCV2783638 | rs3761846 | hCV15751719 | rs2146838 | 0.51 | 0.329406037 | 0.472 |
| hCV2783638 | rs3761846 | hCV15757738 | rs2302498 | 0.51 | 0.329406037 | 0.4266 |
| hCV2783638 | rs3761846 | hCV15849116 | rs2900180 | 0.51 | 0.329406037 | 0.6587 |
| hCV2783638 | rs3761846 | hCV15870898 | rs2072438 | 0.51 | 0.329406037 | 0.9671 |
| hCV2783638 | rs3761846 | hCV16124825 | rs2109895 | 0.51 | 0.329406037 | 0.6687 |
| hCV2783638 | rs3761846 | hCV16175379 | rs2239657 | 0.51 | 0.329406037 | 0.6463 |
| hCV2783638 | rs3761846 | hCV16234785 | rs2416811 | 0.51 | 0.329406037 | 0.3301 |
| hCV2783638 | rs3761846 | hCV16234795 | rs2416804 | 0.51 | 0.329406037 | 0.9672 |
| hCV2783638 | rs3761846 | hCV1761888 | rs1953126 | 0.51 | 0.329406037 | 0.6344 |
| hCV2783638 | rs3761846 | hCV1761891 | rs1930778 | 0.51 | 0.329406037 | 0.5775 |
| hCV2783638 | rs3761846 | hCV1761894 | rs1609810 | 0.51 | 0.329406037 | 0.6068 |
| hCV2783638 | rs3761846 | hCV22272588 | rs10760117 | 0.51 | 0.329406037 | 0.3495 |
| hCV2783638 | rs3761846 | hCV2359565 | rs1014530 | 0.51 | 0.329406037 | 1 |
| hCV2783638 | rs3761846 | hCV2359571 | rs25681 | 0.51 | 0.329406037 | 0.3301 |
| hCV2783638 | rs3761846 | hCV25751916 | rs10985070 | 0.51 | 0.329406037 | 0.9671 |
| hCV2783638 | rs3761846 | hCV26144282 | rs10818499 | 0.51 | 0.329406037 | 0.3301 |
| hCV2783638 | rs3761846 | hCV26144291 | rs4570235 | 0.51 | 0.329406037 | 0.3301 |
| hCV2783638 | rs3761846 | hCV26144307 | rs1016468 | 0.51 | 0.329406037 | 0.472 |
| hCV2783638 | rs3761846 | hCV26144332 | rs4837813 | 0.51 | 0.329406037 | 0.4513 |
| hCV2783638 | rs3761846 | hCV2783582 | rs10818482 | 0.51 | 0.329406037 | 0.9671 |
| hCV2783638 | rs3761846 | hCV2783586 | rs2270231 | 0.51 | 0.329406037 | 0.6344 |
| hCV2783638 | rs3761846 | hCV2783589 | rs881375 | 0.51 | 0.329406037 | 0.6344 |
| hCV2783638 | rs3761846 | hCV2783590 | rs6478486 | 0.51 | 0.329406037 | 0.6344 |
| hCV2783638 | rs3761846 | hCV2783591 | rs1468671 | 0.51 | 0.329406037 | 0.6687 |
| hCV2783638 | rs3761846 | hCV2783593 | rs1548783 | 0.51 | 0.329406037 | 0.6645 |
| hCV2783638 | rs3761846 | hCV2783597 | rs1860824 | 0.51 | 0.329406037 | 0.6581 |
| hCV2783638 | rs3761846 | hCV2783599 | rs7046108 | 0.51 | 0.329406037 | 0.6687 |
| hCV2783638 | rs3761846 | hCV2783604 | rs10760126 | 0.51 | 0.329406037 | 1 |
| hCV2783638 | rs3761846 | hCV2783607 | rs9886724 | 0.51 | 0.329406037 | 1 |
| hCV2783638 | rs3761846 | hCV2783608 | rs4836834 | 0.51 | 0.329406037 | 1 |
| hCV2783638 | rs3761846 | hCV2783609 | rs2241003 | 0.51 | 0.329406037 | 0.7074 |
| hCV2783638 | rs3761846 | hCV2783611 | rs10435843 | 0.51 | 0.329406037 | 0.6687 |
| hCV2783638 | rs3761846 | hCV2783618 | rs2239658 | 0.51 | 0.329406037 | 0.6687 |
| hCV2783638 | rs3761846 | hCV2783620 | rs7021880 | 0.51 | 0.329406037 | 0.6088 |
| hCV2783638 | rs3761846 | hCV2783621 | rs2416805 | 0.51 | 0.329406037 | 0.6687 |
| hCV2783638 | rs3761846 | hCV2783622 | rs758959 | 0.51 | 0.329406037 | 0.6687 |
| hCV2783638 | rs3761846 | hCV2783625 | rs10118357 | 0.51 | 0.329406037 | 1 |
| hCV2783638 | rs3761846 | hCV2783630 | rs2269060 | 0.51 | 0.329406037 | 1 |
| hCV2783638 | rs3761846 | hCV2783633 | rs7021049 | 0.51 | 0.329406037 | 1 |
| hCV2783638 | rs3761846 | hCV2783634 | rs1014529 | 0.51 | 0.329406037 | 0.6687 |
| hCV2783638 | rs3761846 | hCV2783635 | rs1930780 | 0.51 | 0.329406037 | 0.6687 |
| hCV2783638 | rs3761846 | hCV2783640 | rs3761847 | 0.51 | 0.329406037 | 0.9672 |
| hCV2783638 | rs3761846 | hCV2783641 | rs2416806 | 0.51 | 0.329406037 | 0.6594 |
| hCV2783638 | rs3761846 | hCV2783647 | rs10739580 | 0.51 | 0.329406037 | 0.6687 |
| hCV2783638 | rs3761846 | hCV2783650 | rs10760129 | 0.51 | 0.329406037 | 1 |
| hCV2783638 | rs3761846 | hCV2783653 | rs10760130 | 0.51 | 0.329406037 | 1 |
| hCV2783638 | rs3761846 | hCV2783655 | rs10818488 | 0.51 | 0.329406037 | 1 |
| hCV2783638 | rs3761846 | hCV2783656 | rs4837804 | 0.51 | 0.329406037 | 0.775 |
| hCV2783638 | rs3761846 | hCV2783659 | rs7039505 | 0.51 | 0.329406037 | 0.6562 |
| hCV2783638 | rs3761846 | hCV2783711 | rs10733650 | 0.51 | 0.329406037 | 0.3723 |
| hCV2783638 | rs3761846 | hCV2783718 | rs10818500 | 0.51 | 0.329406037 | 0.6661 |
| hCV2783638 | rs3761846 | hCV29005955 | rs7036980 | 0.51 | 0.329406037 | 0.4056 |
| hCV2783638 | rs3761846 | hCV29005976 | rs7037195 | 0.51 | 0.329406037 | 1 |
| hCV2783638 | rs3761846 | hCV29005978 | rs7021206 | 0.51 | 0.329406037 | 0.7031 |
| hCV2783638 | rs3761846 | hCV29006006 | rs7034390 | 0.51 | 0.329406037 | 0.6344 |
| hCV2783638 | rs3761846 | hCV29879049 | rs9792437 | 0.51 | 0.329406037 | 0.4468 |
| hCV2783638 | rs3761846 | hCV3045812 | rs7030849 | 0.51 | 0.329406037 | 0.4468 |
| hCV2783638 | rs3761846 | hCV30830319 | rs7037673 | 0.51 | 0.329406037 | 0.517 |
| hCV2783638 | rs3761846 | hCV30830325 | rs10818494 | 0.51 | 0.329406037 | 0.4154 |

TABLE 4-continued

| Interrogated SNP | Interrogated rs | LD SNP | LD SNP rs | Power | Threshold r² | r² |
|---|---|---|---|---|---|---|
| hCV2783638 | rs3761846 | hCV30830340 | rs10760134 | 0.51 | 0.329406037 | 0.3949 |
| hCV2783638 | rs3761846 | hCV30830341 | rs7040033 | 0.51 | 0.329406037 | 0.3949 |
| hCV2783638 | rs3761846 | hCV30830419 | rs10985140 | 0.51 | 0.329406037 | 0.6317 |
| hCV2783638 | rs3761846 | hCV30830474 | rs10739590 | 0.51 | 0.329406037 | 0.5169 |
| hCV2783638 | rs3761846 | hCV30830638 | rs10985073 | 0.51 | 0.329406037 | 0.9671 |
| hCV2783638 | rs3761846 | hCV30830725 | rs7864019 | 0.51 | 0.329406037 | 0.6687 |
| hCV2783638 | rs3761846 | hCV30830832 | rs10733648 | 0.51 | 0.329406037 | 0.6687 |
| hCV2783638 | rs3761846 | hCV30830909 | rs11794516 | 0.51 | 0.329406037 | 0.9671 |
| hCV2783638 | rs3761846 | hCV7577254 | rs942152 | 0.51 | 0.329406037 | 0.3797 |
| hCV2783638 | rs3761846 | hCV7577317 | rs1323472 | 0.51 | 0.329406037 | 0.6604 |
| hCV2783638 | rs3761846 | hCV7577331 | rs1468673 | 0.51 | 0.329406037 | 0.6604 |
| hCV2783638 | rs3761846 | hCV7577337 | rs993247 | 0.51 | 0.329406037 | 0.3301 |
| hCV2783638 | rs3761846 | hCV7577344 | rs876445 | 0.51 | 0.329406037 | 0.6687 |
| hCV2783638 | rs3761846 | hCV782875 | rs746182 | 0.51 | 0.329406037 | 0.4513 |
| hCV2783641 | rs2416806 | hCV11266229 | rs10435844 | 0.51 | 0.450433113 | 1 |
| hCV2783641 | rs2416806 | hCV11266268 | rs10760121 | 0.51 | 0.450433113 | 1 |
| hCV2783641 | rs2416806 | hCV11720350 | rs2057469 | 0.51 | 0.450433113 | 0.4561 |
| hCV2783641 | rs2416806 | hCV11720413 | rs1930782 | 0.51 | 0.450433113 | 0.6594 |
| hCV2783641 | rs2416806 | hCV11720414 | rs1930781 | 0.51 | 0.450433113 | 1 |
| hCV2783641 | rs2416806 | hCV15849105 | rs2900185 | 0.51 | 0.450433113 | 0.4819 |
| hCV2783641 | rs2416806 | hCV15849116 | rs2900180 | 0.51 | 0.450433113 | 1 |
| hCV2783641 | rs2416806 | hCV15870898 | rs2072438 | 0.51 | 0.450433113 | 0.6594 |
| hCV2783641 | rs2416806 | hCV16124825 | rs2109895 | 0.51 | 0.450433113 | 1 |
| hCV2783641 | rs2416806 | hCV16175379 | rs2239657 | 0.51 | 0.450433113 | 0.9652 |
| hCV2783641 | rs2416806 | hCV16234795 | rs2416804 | 0.51 | 0.450433113 | 0.6235 |
| hCV2783641 | rs2416806 | hCV16234838 | rs2416819 | 0.51 | 0.450433113 | 0.4561 |
| hCV2783641 | rs2416806 | hCV16234840 | rs2416817 | 0.51 | 0.450433113 | 0.4819 |
| hCV2783641 | rs2416806 | hCV1632195 | rs1998505 | 0.51 | 0.450433113 | 0.4819 |
| hCV2783641 | rs2416806 | hCV1761888 | rs1953126 | 0.51 | 0.450433113 | 1 |
| hCV2783641 | rs2416806 | hCV1761891 | rs1930778 | 0.51 | 0.450433113 | 1 |
| hCV2783641 | rs2416806 | hCV1761894 | rs1609810 | 0.51 | 0.450433113 | 1 |
| hCV2783641 | rs2416806 | hCV2359565 | rs1014530 | 0.51 | 0.450433113 | 0.6594 |
| hCV2783641 | rs2416806 | hCV25613469 | rs10760157 | 0.51 | 0.450433113 | 0.4561 |
| hCV2783641 | rs2416806 | hCV25751916 | rs10985070 | 0.51 | 0.450433113 | 0.6594 |
| hCV2783641 | rs2416806 | hCV25771057 | rs10760150 | 0.51 | 0.450433113 | 0.4819 |
| hCV2783641 | rs2416806 | hCV2783582 | rs10818482 | 0.51 | 0.450433113 | 0.6594 |
| hCV2783641 | rs2416806 | hCV2783586 | rs2270231 | 0.51 | 0.450433113 | 1 |
| hCV2783641 | rs2416806 | hCV2783589 | rs881375 | 0.51 | 0.450433113 | 1 |
| hCV2783641 | rs2416806 | hCV2783590 | rs6478486 | 0.51 | 0.450433113 | 1 |
| hCV2783641 | rs2416806 | hCV2783591 | rs1468671 | 0.51 | 0.450433113 | 1 |
| hCV2783641 | rs2416806 | hCV2783593 | rs1548783 | 0.51 | 0.450433113 | 1 |
| hCV2783641 | rs2416806 | hCV2783597 | rs1860824 | 0.51 | 0.450433113 | 1 |
| hCV2783641 | rs2416806 | hCV2783599 | rs7046108 | 0.51 | 0.450433113 | 1 |
| hCV2783641 | rs2416806 | hCV2783604 | rs10760126 | 0.51 | 0.450433113 | 0.6785 |
| hCV2783641 | rs2416806 | hCV2783607 | rs9886724 | 0.51 | 0.450433113 | 0.6785 |
| hCV2783641 | rs2416806 | hCV2783608 | rs4836834 | 0.51 | 0.450433113 | 0.6594 |
| hCV2783641 | rs2416806 | hCV2783609 | rs2241003 | 0.51 | 0.450433113 | 0.9321 |
| hCV2783641 | rs2416806 | hCV2783611 | rs10435843 | 0.51 | 0.450433113 | 1 |
| hCV2783641 | rs2416806 | hCV2783618 | rs2239658 | 0.51 | 0.450433113 | 1 |
| hCV2783641 | rs2416806 | hCV2783620 | rs7021880 | 0.51 | 0.450433113 | 0.9275 |
| hCV2783641 | rs2416806 | hCV2783621 | rs2416805 | 0.51 | 0.450433113 | 1 |
| hCV2783641 | rs2416806 | hCV2783622 | rs758959 | 0.51 | 0.450433113 | 1 |
| hCV2783641 | rs2416806 | hCV2783625 | rs10118357 | 0.51 | 0.450433113 | 0.655 |
| hCV2783641 | rs2416806 | hCV2783630 | rs2269060 | 0.51 | 0.450433113 | 0.6594 |
| hCV2783641 | rs2416806 | hCV2783633 | rs7021049 | 0.51 | 0.450433113 | 0.6594 |
| hCV2783641 | rs2416806 | hCV2783634 | rs1014529 | 0.51 | 0.450433113 | 1 |
| hCV2783641 | rs2416806 | hCV2783635 | rs1930780 | 0.51 | 0.450433113 | 1 |
| hCV2783641 | rs2416806 | hCV2783638 | rs3761846 | 0.51 | 0.450433113 | 0.6594 |
| hCV2783641 | rs2416806 | hCV2783640 | rs3761847 | 0.51 | 0.450433113 | 0.6235 |
| hCV2783641 | rs2416806 | hCV2783647 | rs10739580 | 0.51 | 0.450433113 | 1 |
| hCV2783641 | rs2416806 | hCV2783650 | rs10760129 | 0.51 | 0.450433113 | 0.6594 |
| hCV2783641 | rs2416806 | hCV2783653 | rs10760130 | 0.51 | 0.450433113 | 0.6594 |
| hCV2783641 | rs2416806 | hCV2783655 | rs10818488 | 0.51 | 0.450433113 | 0.6594 |
| hCV2783641 | rs2416806 | hCV2783656 | rs4837804 | 0.51 | 0.450433113 | 0.8918 |
| hCV2783641 | rs2416806 | hCV2783659 | rs7039505 | 0.51 | 0.450433113 | 1 |
| hCV2783641 | rs2416806 | hCV27912350 | rs4837808 | 0.51 | 0.450433113 | 0.4819 |
| hCV2783641 | rs2416806 | hCV27912351 | rs4837809 | 0.51 | 0.450433113 | 0.4819 |
| hCV2783641 | rs2416806 | hCV29005976 | rs7037195 | 0.51 | 0.450433113 | 0.6594 |
| hCV2783641 | rs2416806 | hCV29005978 | rs7021206 | 0.51 | 0.450433113 | 1 |
| hCV2783641 | rs2416806 | hCV29006006 | rs7034390 | 0.51 | 0.450433113 | 1 |
| hCV2783641 | rs2416806 | hCV30059070 | rs10156413 | 0.51 | 0.450433113 | 0.5429 |
| hCV2783641 | rs2416806 | hCV3045792 | rs6478499 | 0.51 | 0.450433113 | 0.4996 |
| hCV2783641 | rs2416806 | hCV30563729 | rs9299273 | 0.51 | 0.450433113 | 0.4819 |
| hCV2783641 | rs2416806 | hCV30830468 | rs10818507 | 0.51 | 0.450433113 | 0.4643 |
| hCV2783641 | rs2416806 | hCV30830473 | rs7036649 | 0.51 | 0.450433113 | 0.4829 |
| hCV2783641 | rs2416806 | hCV30830484 | rs10818508 | 0.51 | 0.450433113 | 0.4819 |
| hCV2783641 | rs2416806 | hCV30830486 | rs10760149 | 0.51 | 0.450433113 | 0.4819 |

TABLE 4-continued

| Interrogated SNP | Interrogated rs | LD SNP | LD SNP rs | Power | Threshold r² | r² |
| --- | --- | --- | --- | --- | --- | --- |
| hCV2783641 | rs2416806 | hCV30830503 | rs4837811 | 0.51 | 0.450433113 | 0.4819 |
| hCV2783641 | rs2416806 | hCV30830512 | rs10818512 | 0.51 | 0.450433113 | 0.4561 |
| hCV2783641 | rs2416806 | hCV30830521 | rs10818513 | 0.51 | 0.450433113 | 0.4561 |
| hCV2783641 | rs2416806 | hCV30830536 | rs7047038 | 0.51 | 0.450433113 | 0.4561 |
| hCV2783641 | rs2416806 | hCV30830638 | rs10985073 | 0.51 | 0.450433113 | 0.6594 |
| hCV2783641 | rs2416806 | hCV30830725 | rs7864019 | 0.51 | 0.450433113 | 1 |
| hCV2783641 | rs2416806 | hCV30830832 | rs10733648 | 0.51 | 0.450433113 | 1 |
| hCV2783641 | rs2416806 | hCV30830909 | rs11794516 | 0.51 | 0.450433113 | 0.6594 |
| hCV2783641 | rs2416806 | hCV7577250 | rs942153 | 0.51 | 0.450433113 | 0.4561 |
| hCV2783641 | rs2416806 | hCV7577271 | rs1535655 | 0.51 | 0.450433113 | 0.4561 |
| hCV2783641 | rs2416806 | hCV7577287 | rs1323478 | 0.51 | 0.450433113 | 0.4819 |
| hCV2783641 | rs2416806 | hCV7577296 | rs1407910 | 0.51 | 0.450433113 | 0.4819 |
| hCV2783641 | rs2416806 | hCV7577344 | rs876445 | 0.51 | 0.450433113 | 1 |
| hCV2783653 | rs10760130 | hCV11266229 | rs10435844 | 0.51 | 0.410057696 | 0.6687 |
| hCV2783653 | rs10760130 | hCV11266268 | rs10760121 | 0.51 | 0.410057696 | 0.6344 |
| hCV2783653 | rs10760130 | hCV11720351 | rs1885995 | 0.51 | 0.410057696 | 0.472 |
| hCV2783653 | rs10760130 | hCV11720413 | rs1930782 | 0.51 | 0.410057696 | 1 |
| hCV2783653 | rs10760130 | hCV11720414 | rs1930781 | 0.51 | 0.410057696 | 0.6687 |
| hCV2783653 | rs10760130 | hCV15751717 | rs2296077 | 0.51 | 0.410057696 | 0.4129 |
| hCV2783653 | rs10760130 | hCV15751719 | rs2146838 | 0.51 | 0.410057696 | 0.472 |
| hCV2783653 | rs10760130 | hCV15757738 | rs2302498 | 0.51 | 0.410057696 | 0.4266 |
| hCV2783653 | rs10760130 | hCV15849116 | rs2900180 | 0.51 | 0.410057696 | 0.6587 |
| hCV2783653 | rs10760130 | hCV15870898 | rs2072438 | 0.51 | 0.410057696 | 0.9671 |
| hCV2783653 | rs10760130 | hCV16124825 | rs2109895 | 0.51 | 0.410057696 | 0.6687 |
| hCV2783653 | rs10760130 | hCV16175379 | rs2239657 | 0.51 | 0.410057696 | 0.6463 |
| hCV2783653 | rs10760130 | hCV16234795 | rs2416804 | 0.51 | 0.410057696 | 0.9672 |
| hCV2783653 | rs10760130 | hCV1761888 | rs1953126 | 0.51 | 0.410057696 | 0.6344 |
| hCV2783653 | rs10760130 | hCV1761891 | rs1930778 | 0.51 | 0.410057696 | 0.5775 |
| hCV2783653 | rs10760130 | hCV1761894 | rs1609810 | 0.51 | 0.410057696 | 0.6068 |
| hCV2783653 | rs10760130 | hCV2359565 | rs1014530 | 0.51 | 0.410057696 | 1 |
| hCV2783653 | rs10760130 | hCV25751916 | rs10985070 | 0.51 | 0.410057696 | 0.9671 |
| hCV2783653 | rs10760130 | hCV26144307 | rs1016468 | 0.51 | 0.410057696 | 0.472 |
| hCV2783653 | rs10760130 | hCV26144332 | rs4837813 | 0.51 | 0.410057696 | 0.4513 |
| hCV2783653 | rs10760130 | hCV2783582 | rs10818482 | 0.51 | 0.410057696 | 0.9671 |
| hCV2783653 | rs10760130 | hCV2783586 | rs2270231 | 0.51 | 0.410057696 | 0.6344 |
| hCV2783653 | rs10760130 | hCV2783589 | rs881375 | 0.51 | 0.410057696 | 0.6344 |
| hCV2783653 | rs10760130 | hCV2783590 | rs6478486 | 0.51 | 0.410057696 | 0.6344 |
| hCV2783653 | rs10760130 | hCV2783591 | rs1468671 | 0.51 | 0.410057696 | 0.6687 |
| hCV2783653 | rs10760130 | hCV2783593 | rs1548783 | 0.51 | 0.410057696 | 0.6645 |
| hCV2783653 | rs10760130 | hCV2783597 | rs1860824 | 0.51 | 0.410057696 | 0.6581 |
| hCV2783653 | rs10760130 | hCV2783599 | rs7046108 | 0.51 | 0.410057696 | 0.6687 |
| hCV2783653 | rs10760130 | hCV2783604 | rs10760126 | 0.51 | 0.410057696 | 1 |
| hCV2783653 | rs10760130 | hCV2783607 | rs9886724 | 0.51 | 0.410057696 | 1 |
| hCV2783653 | rs10760130 | hCV2783608 | rs4836834 | 00.51 | 0.410057696 | 1 |
| hCV2783653 | rs10760130 | hCV2783609 | rs2241003 | 0.51 | 0.410057696 | 0.7074 |
| hCV2783653 | rs10760130 | hCV2783611 | rs10435843 | 0.51 | 0.410057696 | 0.6687 |
| hCV2783653 | rs10760130 | hCV2783618 | rs2239658 | 0.51 | 0.410057696 | 0.6687 |
| hCV2783653 | rs10760130 | hCV2783620 | rs7021880 | 0.51 | 0.410057696 | 0.6088 |
| hCV2783653 | rs10760130 | hCV2783621 | rs2416805 | 0.51 | 0.410057696 | 0.6687 |
| hCV2783653 | rs10760130 | hCV2783622 | rs758959 | 0.51 | 0.410057696 | 0.6687 |
| hCV2783653 | rs10760130 | hCV2783625 | rs10118357 | 0.51 | 0.410057696 | 1 |
| hCV2783653 | rs10760130 | hCV2783630 | rs2269060 | 0.51 | 0.410057696 | 1 |
| hCV2783653 | rs10760130 | hCV2783633 | rs7021049 | 0.51 | 0.410057696 | 1 |
| hCV2783653 | rs10760130 | hCV2783634 | rs1014529 | 0.51 | 0.410057696 | 0.6687 |
| hCV2783653 | rs10760130 | hCV2783635 | rs1930780 | 0.51 | 0.410057696 | 0.6687 |
| hCV2783653 | rs10760130 | hCV2783638 | rs3761846 | 0.51 | 0.410057696 | 1 |
| hCV2783653 | rs10760130 | hCV2783640 | rs3761847 | 0.51 | 0.410057696 | 0.9672 |
| hCV2783653 | rs10760130 | hCV2783641 | rs2416806 | 0.51 | 0.410057696 | 0.6594 |
| hCV2783653 | rs10760130 | hCV2783647 | rs10739580 | 0.51 | 0.410057696 | 0.6687 |
| hCV2783653 | rs10760130 | hCV2783650 | rs10760129 | 0.51 | 0.410057696 | 1 |
| hCV2783653 | rs10760130 | hCV2783655 | rs10818488 | 0.51 | 0.410057696 | 1 |
| hCV2783653 | rs10760130 | hCV2783656 | rs4837804 | 0.51 | 0.410057696 | 0.775 |
| hCV2783653 | rs10760130 | hCV2783659 | rs7039505 | 0.51 | 0.410057696 | 0.6562 |
| hCV2783653 | rs10760130 | hCV2783718 | rs10818500 | 0.51 | 0.410057696 | 0.6661 |
| hCV2783653 | rs10760130 | hCV29005976 | rs7037195 | 0.51 | 0.410057696 | 1 |
| hCV2783653 | rs10760130 | hCV29005978 | rs7021206 | 0.51 | 0.410057696 | 0.7031 |
| hCV2783653 | rs10760130 | hCV29006006 | rs7034390 | 0.51 | 0.410057696 | 0.6344 |
| hCV2783653 | rs10760130 | hCV29879049 | rs9792437 | 0.51 | 0.410057696 | 0.4468 |
| hCV2783653 | rs10760130 | hCV3045812 | rs7030849 | 0.51 | 0.410057696 | 0.4468 |
| hCV2783653 | rs10760130 | hCV30830319 | rs7037673 | 0.51 | 0.410057696 | 0.517 |
| hCV2783653 | rs10760130 | hCV30830325 | rs10818494 | 0.51 | 0.410057696 | 0.4154 |
| hCV2783653 | rs10760130 | hCV30830419 | rs10985140 | 0.51 | 0.410057696 | 0.6317 |
| hCV2783653 | rs10760130 | hCV30830474 | rs10739590 | 0.51 | 0.410057696 | 0.5169 |
| hCV2783653 | rs10760130 | hCV30830638 | rs10985073 | 0.51 | 0.410057696 | 0.9671 |
| hCV2783653 | rs10760130 | hCV30830725 | rs7864019 | 0.51 | 0.410057696 | 0.6687 |
| hCV2783653 | rs10760130 | hCV30830832 | rs10733648 | 0.51 | 0.410057696 | 0.6687 |
| hCV2783653 | rs10760130 | hCV30830909 | rs11794516 | 0.51 | 0.410057696 | 0.9671 |

TABLE 4-continued

| Interrogated SNP | Interrogated rs | LD SNP | LD SNP rs | Power | Threshold r² | r² |
|---|---|---|---|---|---|---|
| hCV2783653 | rs10760130 | hCV7577317 | rs1323472 | 0.51 | 0.410057696 | 0.6604 |
| hCV2783653 | rs10760130 | hCV7577331 | rs1468673 | 0.51 | 0.410057696 | 0.6604 |
| hCV2783653 | rs10760130 | hCV7577344 | rs876445 | 0.51 | 0.410057696 | 0.6687 |
| hCV2783653 | rs10760130 | hCV782875 | rs746182 | 0.51 | 0.410057696 | 0.4513 |
| hCV2783655 | rs10818488 | hCV11266229 | rs10435844 | 0.51 | 0.366210234 | 0.6687 |
| hCV2783655 | rs10818488 | hCV11266268 | rs10760121 | 0.51 | 0.366210234 | 0.6344 |
| hCV2783655 | rs10818488 | hCV11720351 | rs1885995 | 0.51 | 0.366210234 | 0.472 |
| hCV2783655 | rs10818488 | hCV11720413 | rs1930782 | 0.51 | 0.366210234 | 1 |
| hCV2783655 | rs10818488 | hCV11720414 | rs1930781 | 0.51 | 0.366210234 | 0.6687 |
| hCV2783655 | rs10818488 | hCV15751717 | rs2296077 | 0.51 | 0.366210234 | 0.4129 |
| hCV2783655 | rs10818488 | hCV15751719 | rs2146838 | 0.51 | 0.366210234 | 0.472 |
| hCV2783655 | rs10818488 | hCV15757738 | rs2302498 | 0.51 | 0.366210234 | 0.4266 |
| hCV2783655 | rs10818488 | hCV15849116 | rs2900180 | 0.51 | 0.366210234 | 0.6587 |
| hCV2783655 | rs10818488 | hCV15870898 | rs2072438 | 0.51 | 0.366210234 | 0.9671 |
| hCV2783655 | rs10818488 | hCV16124825 | rs2109895 | 0.51 | 0.366210234 | 0.6687 |
| hCV2783655 | rs10818488 | hCV16175379 | rs2239657 | 0.51 | 0.366210234 | 0.6463 |
| hCV2783655 | rs10818488 | hCV16234795 | rs2416804 | 0.51 | 0.366210234 | 0.9672 |
| hCV2783655 | rs10818488 | hCV1761888 | rs1953126 | 0.51 | 0.366210234 | 0.6344 |
| hCV2783655 | rs10818488 | hCV1761891 | rs1930778 | 0.51 | 0.366210234 | 0.5775 |
| hCV2783655 | rs10818488 | hCV1761894 | rs1609810 | 0.51 | 0.366210234 | 0.6068 |
| hCV2783655 | rs10818488 | hCV2359565 | rs1014530 | 0.51 | 0.366210234 | 1 |
| hCV2783655 | rs10818488 | hCV25751916 | rs10985070 | 0.51 | 0.366210234 | 0.9671 |
| hCV2783655 | rs10818488 | hCV26144307 | rs1016468 | 0.51 | 0.366210234 | 0.472 |
| hCV2783655 | rs10818488 | hCV26144332 | rs4837813 | 0.51 | 0.366210234 | 0.4513 |
| hCV2783655 | rs10818488 | hCV2783582 | rs10818482 | 0.51 | 0.366210234 | 0.9671 |
| hCV2783655 | rs10818488 | hCV2783586 | rs2270231 | 0.51 | 0.366210234 | 0.6344 |
| hCV2783655 | rs10818488 | hCV2783589 | rs881375 | 0.51 | 0.366210234 | 0.6344 |
| hCV2783655 | rs10818488 | hCV2783590 | rs6478486 | 0.51 | 0.366210234 | 0.6344 |
| hCV2783655 | rs10818488 | hCV2783591 | rs1468671 | 0.51 | 0.366210234 | 0.6687 |
| hCV2783655 | rs10818488 | hCV2783593 | rs1548783 | 0.51 | 0.366210234 | 0.6645 |
| hCV2783655 | rs10818488 | hCV2783597 | rs1860824 | 0.51 | 0.366210234 | 0.6581 |
| hCV2783655 | rs10818488 | hCV2783599 | rs7046108 | 0.51 | 0.366210234 | 0.6687 |
| hCV2783655 | rs10818488 | hCV2783604 | rs10760126 | 0.51 | 0.366210234 | 1 |
| hCV2783655 | rs10818488 | hCV2783607 | rs9886724 | 0.51 | 0.366210234 | 1 |
| hCV2783655 | rs10818488 | hCV2783608 | rs4836834 | 0.51 | 0.366210234 | 1 |
| hCV2783655 | rs10818488 | hCV2783609 | rs2241003 | 0.51 | 0.366210234 | 0.7074 |
| hCV2783655 | rs10818488 | hCV2783611 | rs10435843 | 0.51 | 0.366210234 | 0.6687 |
| hCV2783655 | rs10818488 | hCV2783618 | rs2239658 | 0.51 | 0.366210234 | 0.6687 |
| hCV2783655 | rs10818488 | hCV2783620 | rs7021880 | 0.51 | 0.366210234 | 0.6088 |
| hCV2783655 | rs10818488 | hCV2783621 | rs2416805 | 0.51 | 0.366210234 | 0.6687 |
| hCV2783655 | rs10818488 | hCV2783622 | rs758959 | 0.51 | 0.366210234 | 0.6687 |
| hCV2783655 | rs10818488 | hCV2783625 | rs10118357 | 0.51 | 0.366210234 | 1 |
| hCV2783655 | rs10818488 | hCV2783630 | rs2269060 | 0.51 | 0.366210234 | 1 |
| hCV2783655 | rs10818488 | hCV2783633 | rs7021049 | 0.51 | 0.366210234 | 1 |
| hCV2783655 | rs10818488 | hCV2783634 | rs1014529 | 0.51 | 0.366210234 | 0.6687 |
| hCV2783655 | rs10818488 | hCV2783635 | rs1930780 | 0.51 | 0.366210234 | 0.6687 |
| hCV2783655 | rs10818488 | hCV2783638 | rs3761846 | 0.51 | 0.366210234 | 1 |
| hCV2783655 | rs10818488 | hCV2783640 | rs3761847 | 0.51 | 0.366210234 | 0.9672 |
| hCV2783655 | rs10818488 | hCV2783641 | rs2416806 | 0.51 | 0.366210234 | 0.6594 |
| hCV2783655 | rs10818488 | hCV2783647 | rs10739580 | 0.51 | 0.366210234 | 0.6687 |
| hCV2783655 | rs10818488 | hCV2783650 | rs10760129 | 0.51 | 0.366210234 | 1 |
| hCV2783655 | rs10818488 | hCV2783653 | rs10760130 | 0.51 | 0.366210234 | 1 |
| hCV2783655 | rs10818488 | hCV2783656 | rs4837804 | 0.51 | 0.366210234 | 0.775 |
| hCV2783655 | rs10818488 | hCV2783659 | rs7039505 | 0.51 | 0.366210234 | 0.6562 |
| hCV2783655 | rs10818488 | hCV2783711 | rs10733650 | 0.51 | 0.366210234 | 0.3723 |
| hCV2783655 | rs10818488 | hCV2783718 | rs10818500 | 0.51 | 0.366210234 | 0.6661 |
| hCV2783655 | rs10818488 | hCV29005955 | rs7036980 | 0.51 | 0.366210234 | 0.4056 |
| hCV2783655 | rs10818488 | hCV29005976 | rs7037195 | 0.51 | 0.366210234 | 1 |
| hCV2783655 | rs10818488 | hCV29005978 | rs7021206 | 0.51 | 0.366210234 | 0.7031 |
| hCV2783655 | rs10818488 | hCV29006006 | rs7034390 | 0.51 | 0.366210234 | 0.6344 |
| hCV2783655 | rs10818488 | hCV29879049 | rs9792437 | 0.51 | 0.366210234 | 0.4468 |
| hCV2783655 | rs10818488 | hCV3045812 | rs7030849 | 0.51 | 0.366210234 | 0.4468 |
| hCV2783655 | rs10818488 | hCV30830319 | rs7037673 | 0.51 | 0.366210234 | 0.517 |
| hCV2783655 | rs10818488 | hCV30830325 | rs10818494 | 0.51 | 0.366210234 | 0.4154 |
| hCV2783655 | rs10818488 | hCV30830340 | rs10760134 | 0.51 | 0.366210234 | 0.3949 |
| hCV2783655 | rs10818488 | hCV30830341 | rs7040033 | 0.51 | 0.366210234 | 0.3949 |
| hCV2783655 | rs10818488 | hCV30830419 | rs10985140 | 0.51 | 0.366210234 | 0.6317 |
| hCV2783655 | rs10818488 | hCV30830474 | rs10739590 | 0.51 | 0.366210234 | 0.5169 |
| hCV2783655 | rs10818488 | hCV30830638 | rs10985073 | 0.51 | 0.366210234 | 0.9671 |
| hCV2783655 | rs10818488 | hCV30830725 | rs7864019 | 0.51 | 0.366210234 | 0.6687 |
| hCV2783655 | rs10818488 | hCV30830832 | rs10733648 | 0.51 | 0.366210234 | 0.6687 |
| hCV2783655 | rs10818488 | hCV30830909 | rs11794516 | 0.51 | 0.366210234 | 0.9671 |
| hCV2783655 | rs10818488 | hCV7577254 | rs942152 | 0.51 | 0.366210234 | 0.3797 |
| hCV2783655 | rs10818488 | hCV7577317 | rs1323472 | 0.51 | 0.366210234 | 0.6604 |
| hCV2783655 | rs10818488 | hCV7577331 | rs1468673 | 0.51 | 0.366210234 | 0.6604 |
| hCV2783655 | rs10818488 | hCV7577344 | rs876445 | 0.51 | 0.366210234 | 0.6687 |
| hCV2783655 | rs10818488 | hCV782875 | rs746182 | 0.51 | 0.366210234 | 0.4513 |

TABLE 4-continued

| Interrogated SNP | Interrogated rs | LD SNP | LD SNP rs | Power | Threshold r² | r² |
|---|---|---|---|---|---|---|
| hCV2783677 | rs2269066 | hCV2783682 | rs7861142 | 0.51 | 0.847112965 | 1 |
| hCV29005933 | rs7042135 | hCV11720402 | rs17611 | 0.51 | 0.926005625 | 0.9646 |
| hCV29005933 | rs7042135 | hCV15755658 | rs2300934 | 0.51 | 0.926005625 | 1 |
| hCV29005933 | rs7042135 | hCV16234785 | rs2416811 | 0.51 | 0.926005625 | 0.9646 |
| hCV29005933 | rs7042135 | hCV2359571 | rs25681 | 0.51 | 0.926005625 | 0.9646 |
| hCV29005933 | rs7042135 | hCV26144282 | rs10818499 | 0.51 | 0.926005625 | 0.9646 |
| hCV29005933 | rs7042135 | hCV26144291 | rs4570235 | 0.51 | 0.926005625 | 0.9646 |
| hCV29005933 | rs7042135 | hCV2783711 | rs10733650 | 0.51 | 0.926005625 | 0.9646 |
| hCV29005933 | rs7042135 | hCV29005936 | rs6478498 | 0.51 | 0.926005625 | 1 |
| hCV29005933 | rs7042135 | hCV29734592 | rs10435889 | 0.51 | 0.926005625 | 0.9635 |
| hCV29005933 | rs7042135 | hCV30167357 | rs7022941 | 0.51 | 0.926005625 | 0.928 |
| hCV29005933 | rs7042135 | hCV30830415 | rs7855998 | 0.51 | 0.926005625 | 1 |
| hCV29005933 | rs7042135 | hCV30830427 | rs10760142 | 0.51 | 0.926005625 | 1 |
| hCV29005933 | rs7042135 | hCV7577337 | rs993247 | 0.51 | 0.926005625 | 0.9646 |
| hCV29005978 | rs7021206 | hCV11266229 | rs10435844 | 0.51 | 0.423423973 | 1 |
| hCV29005978 | rs7021206 | hCV11266268 | rs10760121 | 0.51 | 0.423423973 | 0.9651 |
| hCV29005978 | rs7021206 | hCV11720350 | rs2057469 | 0.51 | 0.423423973 | 0.4264 |
| hCV29005978 | rs7021206 | hCV11720413 | rs1930782 | 0.51 | 0.423423973 | 0.7031 |
| hCV29005978 | rs7021206 | hCV11720414 | rs1930781 | 0.51 | 0.423423973 | 1 |
| hCV29005978 | rs7021206 | hCV15849105 | rs2900185 | 0.51 | 0.423423973 | 0.4516 |
| hCV29005978 | rs7021206 | hCV15849116 | rs2900180 | 0.51 | 0.423423973 | 1 |
| hCV29005978 | rs7021206 | hCV15870898 | rs2072438 | 0.51 | 0.423423973 | 0.6788 |
| hCV29005978 | rs7021206 | hCV16124825 | rs2109895 | 0.51 | 0.423423973 | 1 |
| hCV29005978 | rs7021206 | hCV16175379 | rs2239657 | 0.51 | 0.423423973 | 0.9649 |
| hCV29005978 | rs7021206 | hCV16234795 | rs2416804 | 0.51 | 0.423423973 | 0.6666 |
| hCV29005978 | rs7021206 | hCV16234838 | rs2416819 | 0.51 | 0.423423973 | 0.4264 |
| hCV29005978 | rs7021206 | hCV16234840 | rs2416817 | 0.51 | 0.423423973 | 0.4516 |
| hCV29005978 | rs7021206 | hCV1632195 | rs1998505 | 0.51 | 0.423423973 | 0.4516 |
| hCV29005978 | rs7021206 | hCV1761888 | rs1953126 | 0.51 | 0.423423973 | 0.9651 |
| hCV29005978 | rs7021206 | hCV1761891 | rs1930778 | 0.51 | 0.423423973 | 0.9582 |
| hCV29005978 | rs7021206 | hCV1761894 | rs1609810 | 0.51 | 0.423423973 | 0.9588 |
| hCV29005978 | rs7021206 | hCV2359565 | rs1014530 | 0.51 | 0.423423973 | 0.7031 |
| hCV29005978 | rs7021206 | hCV25613469 | rs10760157 | 0.51 | 0.423423973 | 0.4264 |
| hCV29005978 | rs7021206 | hCV25751916 | rs10985070 | 0.51 | 0.423423973 | 0.6788 |
| hCV29005978 | rs7021206 | hCV25771057 | rs10760150 | 0.51 | 0.423423973 | 0.4516 |
| hCV29005978 | rs7021206 | hCV2783582 | rs10818482 | 0.51 | 0.423423973 | 0.6788 |
| hCV29005978 | rs7021206 | hCV2783586 | rs2270231 | 0.51 | 0.423423973 | 0.9651 |
| hCV29005978 | rs7021206 | hCV2783589 | rs881375 | 0.51 | 0.423423973 | 0.9651 |
| hCV29005978 | rs7021206 | hCV2783590 | rs6478486 | 0.51 | 0.423423973 | 0.9651 |
| hCV29005978 | rs7021206 | hCV2783591 | rs1468671 | 0.51 | 0.423423973 | 1 |
| hCV29005978 | rs7021206 | hCV2783593 | rs1548783 | 0.51 | 0.423423973 | 1 |
| hCV29005978 | rs7021206 | hCV2783597 | rs1860824 | 0.51 | 0.423423973 | 1 |
| hCV29005978 | rs7021206 | hCV2783599 | rs7046108 | 0.51 | 0.423423973 | 1 |
| hCV29005978 | rs7021206 | hCV2783604 | rs10760126 | 0.51 | 0.423423973 | 0.7031 |
| hCV29005978 | rs7021206 | hCV2783607 | rs9886724 | 0.51 | 0.423423973 | 0.6941 |
| hCV29005978 | rs7021206 | hCV2783608 | rs4836834 | 0.51 | 0.423423973 | 0.7031 |
| hCV29005978 | rs7021206 | hCV2783609 | rs2241003 | 0.51 | 0.423423973 | 0.929 |
| hCV29005978 | rs7021206 | hCV2783611 | rs10435843 | 0.51 | 0.423423973 | 1 |
| hCV29005978 | rs7021206 | hCV2783618 | rs2239658 | 0.51 | 0.423423973 | 1 |
| hCV29005978 | rs7021206 | hCV2783620 | rs7021880 | 0.51 | 0.423423973 | 0.9271 |
| hCV29005978 | rs7021206 | hCV2783621 | rs2416805 | 0.51 | 0.423423973 | 1 |
| hCV29005978 | rs7021206 | hCV2783622 | rs758959 | 0.51 | 0.423423973 | 1 |
| hCV29005978 | rs7021206 | hCV2783625 | rs10118357 | 0.51 | 0.423423973 | 0.6989 |
| hCV29005978 | rs7021206 | hCV2783630 | rs2269060 | 0.51 | 0.423423973 | 0.7031 |
| hCV29005978 | rs7021206 | hCV2783633 | rs7021049 | 0.51 | 0.423423973 | 0.7031 |
| hCV29005978 | rs7021206 | hCV2783634 | rs1014529 | 0.51 | 0.423423973 | 1 |
| hCV29005978 | rs7021206 | hCV2783635 | rs1930780 | 0.51 | 0.423423973 | 1 |
| hCV29005978 | rs7021206 | hCV2783638 | rs3761846 | 0.51 | 0.423423973 | 0.7031 |
| hCV29005978 | rs7021206 | hCV2783640 | rs3761847 | 0.51 | 0.423423973 | 0.6666 |
| hCV29005978 | rs7021206 | hCV2783641 | rs2416806 | 0.51 | 0.423423973 | 1 |
| hCV29005978 | rs7021206 | hCV2783647 | rs10739580 | 0.51 | 0.423423973 | 1 |
| hCV29005978 | rs7021206 | hCV2783650 | rs10760129 | 0.51 | 0.423423973 | 0.7031 |
| hCV29005978 | rs7021206 | hCV2783653 | rs10760130 | 0.51 | 0.423423973 | 0.7031 |
| hCV29005978 | rs7021206 | hCV2783655 | rs10818488 | 0.51 | 0.423423973 | 0.7031 |
| hCV29005978 | rs7021206 | hCV2783656 | rs4837804 | 0.51 | 0.423423973 | 0.8925 |
| hCV29005978 | rs7021206 | hCV2783659 | rs7039505 | 0.51 | 0.423423973 | 1 |
| hCV29005978 | rs7021206 | hCV27912350 | rs4837808 | 0.51 | 0.423423973 | 0.4516 |
| hCV29005978 | rs7021206 | hCV27912351 | rs4837809 | 0.51 | 0.423423973 | 0.4516 |
| hCV29005978 | rs7021206 | hCV29005923 | rs6478494 | 0.51 | 0.423423973 | 0.4284 |
| hCV29005978 | rs7021206 | hCV29005976 | rs7037195 | 0.51 | 0.423423973 | 0.7031 |
| hCV29005978 | rs7021206 | hCV29006006 | rs7034390 | 0.51 | 0.423423973 | 0.9651 |
| hCV29005978 | rs7021206 | hCV30059070 | rs10156413 | 0.51 | 0.423423973 | 0.5069 |
| hCV29005978 | rs7021206 | hCV3045792 | rs6478499 | 0.51 | 0.423423973 | 0.4687 |
| hCV29005978 | rs7021206 | hCV30563729 | rs9299273 | 0.51 | 0.423423973 | 0.4516 |
| hCV29005978 | rs7021206 | hCV30830468 | rs10818507 | 0.51 | 0.423423973 | 0.4324 |
| hCV29005978 | rs7021206 | hCV30830473 | rs7036649 | 0.51 | 0.423423973 | 0.4503 |
| hCV29005978 | rs7021206 | hCV30830484 | rs10818508 | 0.51 | 0.423423973 | 0.4516 |

TABLE 4-continued

| Interrogated SNP | Interrogated rs | LD SNP | LD SNP rs | Power | Threshold r² | r² |
|---|---|---|---|---|---|---|
| hCV29005978 | rs7021206 | hCV30830486 | rs10760149 | 0.51 | 0.423423973 | 0.4516 |
| hCV29005978 | rs7021206 | hCV30830503 | rs4837811 | 0.51 | 0.423423973 | 0.4516 |
| hCV29005978 | rs7021206 | hCV30830512 | rs10818512 | 0.51 | 0.423423973 | 0.4264 |
| hCV29005978 | rs7021206 | hCV30830521 | rs10818513 | 0.51 | 0.423423973 | 0.4264 |
| hCV29005978 | rs7021206 | hCV30830536 | rs7047038 | 0.51 | 0.423423973 | 0.4264 |
| hCV29005978 | rs7021206 | hCV30830638 | rs10985073 | 0.51 | 0.423423973 | 0.6788 |
| hCV29005978 | rs7021206 | hCV30830725 | rs7864019 | 0.51 | 0.423423973 | 1 |
| hCV29005978 | rs7021206 | hCV30830832 | rs10733648 | 0.51 | 0.423423973 | 1 |
| hCV29005978 | rs7021206 | hCV30830909 | rs11794516 | 0.51 | 0.423423973 | 0.6788 |
| hCV29005978 | rs7021206 | hCV7577250 | rs942153 | 0.51 | 0.423423973 | 0.4264 |
| hCV29005978 | rs7021206 | hCV7577271 | rs1535655 | 0.51 | 0.423423973 | 0.4264 |
| hCV29005978 | rs7021206 | hCV7577287 | rs1323478 | 0.51 | 0.423423973 | 0.4516 |
| hCV29005978 | rs7021206 | hCV7577296 | rs1407910 | 0.51 | 0.423423973 | 0.4516 |
| hCV29005978 | rs7021206 | hCV7577344 | rs876445 | 0.51 | 0.423423973 | 1 |
| hCV29006006 | rs7034390 | hCV11266229 | rs10435844 | 0.51 | 0.424658012 | 0.9666 |
| hCV29006006 | rs7034390 | hCV11266268 | rs10760121 | 0.51 | 0.424658012 | 1 |
| hCV29006006 | rs7034390 | hCV11720350 | rs2057469 | 0.51 | 0.424658012 | 0.4734 |
| hCV29006006 | rs7034390 | hCV11720394 | rs1924081 | 0.51 | 0.424658012 | 0.4414 |
| hCV29006006 | rs7034390 | hCV11720413 | rs1930782 | 0.51 | 0.424658012 | 0.6344 |
| hCV29006006 | rs7034390 | hCV11720414 | rs1930781 | 0.51 | 0.424658012 | 0.9666 |
| hCV29006006 | rs7034390 | hCV15849105 | rs2900185 | 0.51 | 0.424658012 | 0.4989 |
| hCV29006006 | rs7034390 | hCV15849116 | rs2900180 | 0.51 | 0.424658012 | 0.9622 |
| hCV29006006 | rs7034390 | hCV15870898 | rs2072438 | 0.51 | 0.424658012 | 0.6691 |
| hCV29006006 | rs7034390 | hCV16124825 | rs2109895 | 0.51 | 0.424658012 | 0.9666 |
| hCV29006006 | rs7034390 | hCV16175379 | rs2239657 | 0.51 | 0.424658012 | 0.9341 |
| hCV29006006 | rs7034390 | hCV16234795 | rs2416804 | 0.51 | 0.424658012 | 0.6014 |
| hCV29006006 | rs7034390 | hCV16234838 | rs2416819 | 0.51 | 0.424658012 | 0.4734 |
| hCV29006006 | rs7034390 | hCV16234840 | rs2416817 | 0.51 | 0.424658012 | 0.4989 |
| hCV29006006 | rs7034390 | hCV1632195 | rs1998505 | 0.51 | 0.424658012 | 0.4989 |
| hCV29006006 | rs7034390 | hCV1761888 | rs1953126 | 0.51 | 0.424658012 | 1 |
| hCV29006006 | rs7034390 | hCV1761891 | rs1930778 | 0.51 | 0.424658012 | 1 |
| hCV29006006 | rs7034390 | hCV1761894 | rs1609810 | 0.51 | 0.424658012 | 1 |
| hCV29006006 | rs7034390 | hCV2359565 | rs1014530 | 0.51 | 0.424658012 | 0.6344 |
| hCV29006006 | rs7034390 | hCV25472748 | rs10760138 | 0.51 | 0.424658012 | 0.4328 |
| hCV29006006 | rs7034390 | hCV25613469 | rs10760157 | 0.51 | 0.424658012 | 0.4734 |
| hCV29006006 | rs7034390 | hCV25751916 | rs10985070 | 0.51 | 0.424658012 | 0.6691 |
| hCV29006006 | rs7034390 | hCV25771057 | rs10760150 | 0.51 | 0.424658012 | 0.4989 |
| hCV29006006 | rs7034390 | hCV2783582 | rs10818482 | 0.51 | 0.424658012 | 0.6691 |
| hCV29006006 | rs7034390 | hCV2783586 | rs2270231 | 0.51 | 0.424658012 | 1 |
| hCV29006006 | rs7034390 | hCV2783589 | rs881375 | 0.51 | 0.424658012 | 1 |
| hCV29006006 | rs7034390 | hCV2783590 | rs6478486 | 0.51 | 0.424658012 | 1 |
| hCV29006006 | rs7034390 | hCV2783591 | rs1468671 | 0.51 | 0.424658012 | 0.9666 |
| hCV29006006 | rs7034390 | hCV2783593 | rs1548783 | 0.51 | 0.424658012 | 0.9661 |
| hCV29006006 | rs7034390 | hCV2783597 | rs1860824 | 0.51 | 0.424658012 | 0.965 |
| hCV29006006 | rs7034390 | hCV2783599 | rs7046108 | 0.51 | 0.424658012 | 0.9666 |
| hCV29006006 | rs7034390 | hCV2783604 | rs10760126 | 0.51 | 0.424658012 | 0.6526 |
| hCV29006006 | rs7034390 | hCV2783607 | rs9886724 | 0.51 | 0.424658012 | 0.6785 |
| hCV29006006 | rs7034390 | hCV2783608 | rs4836834 | 0.51 | 0.424658012 | 0.6344 |
| hCV29006006 | rs7034390 | hCV2783609 | rs2241003 | 0.51 | 0.424658012 | 0.9321 |
| hCV29006006 | rs7034390 | hCV2783611 | rs10435843 | 0.51 | 0.424658012 | 0.9666 |
| hCV29006006 | rs7034390 | hCV2783618 | rs2239658 | 0.51 | 0.424658012 | 0.9666 |
| hCV29006006 | rs7034390 | hCV2783620 | rs7021880 | 0.51 | 0.424658012 | 0.8974 |
| hCV29006006 | rs7034390 | hCV2783621 | rs2416805 | 0.51 | 0.424658012 | 0.9666 |
| hCV29006006 | rs7034390 | hCV2783622 | rs758959 | 0.51 | 0.424658012 | 0.9666 |
| hCV29006006 | rs7034390 | hCV2783625 | rs10118357 | 0.51 | 0.424658012 | 0.6295 |
| hCV29006006 | rs7034390 | hCV2783630 | rs2269060 | 0.51 | 0.424658012 | 0.6344 |
| hCV29006006 | rs7034390 | hCV2783633 | rs7021049 | 0.51 | 0.424658012 | 0.6344 |
| hCV29006006 | rs7034390 | hCV2783634 | rs1014529 | 0.51 | 0.424658012 | 0.9666 |
| hCV29006006 | rs7034390 | hCV2783635 | rs1930780 | 0.51 | 0.424658012 | 0.9666 |
| hCV29006006 | rs7034390 | hCV2783638 | rs3761846 | 0.51 | 0.424658012 | 0.6344 |
| hCV29006006 | rs7034390 | hCV2783640 | rs3761847 | 0.51 | 0.424658012 | 0.6014 |
| hCV29006006 | rs7034390 | hCV2783641 | rs2416806 | 0.51 | 0.424658012 | 1 |
| hCV29006006 | rs7034390 | hCV2783647 | rs10739580 | 0.51 | 0.424658012 | 0.9666 |
| hCV29006006 | rs7034390 | hCV2783650 | rs10760129 | 0.51 | 0.424658012 | 0.6344 |
| hCV29006006 | rs7034390 | hCV2783653 | rs10760130 | 0.51 | 0.424658012 | 0.6344 |
| hCV29006006 | rs7034390 | hCV2783655 | rs10818488 | 0.51 | 0.424658012 | 0.6344 |
| hCV29006006 | rs7034390 | hCV2783656 | rs4837804 | 0.51 | 0.424658012 | 0.8593 |
| hCV29006006 | rs7034390 | hCV2783659 | rs7039505 | 0.51 | 0.424658012 | 0.9615 |
| hCV29006006 | rs7034390 | hCV27912350 | rs4837808 | 0.51 | 0.424658012 | 0.4989 |
| hCV29006006 | rs7034390 | hCV27912351 | rs4837809 | 0.51 | 0.424658012 | 0.4989 |
| hCV29006006 | rs7034390 | hCV29005922 | rs7033790 | 0.51 | 0.424658012 | 0.4414 |
| hCV29006006 | rs7034390 | hCV29005923 | rs6478494 | 0.51 | 0.424658012 | 0.4648 |
| hCV29006006 | rs7034390 | hCV29005924 | rs7031128 | 0.51 | 0.424658012 | 0.4729 |
| hCV29006006 | rs7034390 | hCV29005931 | rs6478496 | 0.51 | 0.424658012 | 0.4414 |
| hCV29006006 | rs7034390 | hCV29005976 | rs7037195 | 0.51 | 0.424658012 | 0.6344 |
| hCV29006006 | rs7034390 | hCV29005978 | rs7021206 | 0.51 | 0.424658012 | 0.9651 |
| hCV29006006 | rs7034390 | hCV30059070 | rs10156413 | 0.51 | 0.424658012 | 0.5621 |

TABLE 4-continued

| Interrogated SNP | Interrogated rs | LD SNP | LD SNP rs | Power | Threshold r² | r² |
|---|---|---|---|---|---|---|
| hCV29006006 | rs7034390 | hCV3045792 | rs6478499 | 0.51 | 0.424658012 | 0.5164 |
| hCV29006006 | rs7034390 | hCV3045801 | rs2057465 | 0.51 | 0.424658012 | 0.4611 |
| hCV29006006 | rs7034390 | hCV30563728 | rs10156396 | 0.51 | 0.424658012 | 0.429 |
| hCV29006006 | rs7034390 | hCV30563729 | rs9299273 | 0.51 | 0.424658012 | 0.4989 |
| hCV29006006 | rs7034390 | hCV30830395 | rs10985132 | 0.51 | 0.424658012 | 0.4414 |
| hCV29006006 | rs7034390 | hCV30830397 | rs10760139 | 0.51 | 0.424658012 | 0.4414 |
| hCV29006006 | rs7034390 | hCV30830406 | rs7040603 | 0.51 | 0.424658012 | 0.4414 |
| hCV29006006 | rs7034390 | hCV30830407 | rs10739585 | 0.51 | 0.424658012 | 0.4414 |
| hCV29006006 | rs7034390 | hCV30830414 | rs7871371 | 0.51 | 0.424658012 | 0.4541 |
| hCV29006006 | rs7034390 | hCV30830417 | rs7029523 | 0.51 | 0.424658012 | 0.4414 |
| hCV29006006 | rs7034390 | hCV30830468 | rs10818507 | 0.51 | 0.424658012 | 0.4819 |
| hCV29006006 | rs7034390 | hCV30830473 | rs7036649 | 0.51 | 0.424658012 | 0.5014 |
| hCV29006006 | rs7034390 | hCV30830475 | rs10733652 | 0.51 | 0.424658012 | 0.4539 |
| hCV29006006 | rs7034390 | hCV30830484 | rs10818508 | 0.51 | 0.424658012 | 0.4989 |
| hCV29006006 | rs7034390 | hCV30830486 | rs10760149 | 0.51 | 0.424658012 | 0.4989 |
| hCV29006006 | rs7034390 | hCV30830503 | rs4837811 | 0.51 | 0.424658012 | 0.4989 |
| hCV29006006 | rs7034390 | hCV30830512 | rs10818512 | 0.51 | 0.424658012 | 0.4734 |
| hCV29006006 | rs7034390 | hCV30830521 | rs10818513 | 0.51 | 0.424658012 | 0.4734 |
| hCV29006006 | rs7034390 | hCV30830536 | rs7047038 | 0.51 | 0.424658012 | 0.4734 |
| hCV29006006 | rs7034390 | hCV30830638 | rs10985073 | 0.51 | 0.424658012 | 0.6691 |
| hCV29006006 | rs7034390 | hCV30830725 | rs7864019 | 0.51 | 0.424658012 | 0.9666 |
| hCV29006006 | rs7034390 | hCV30830832 | rs10733648 | 0.51 | 0.424658012 | 0.9666 |
| hCV29006006 | rs7034390 | hCV30830909 | rs11794516 | 0.51 | 0.424658012 | 0.6691 |
| hCV29006006 | rs7034390 | hCV7577250 | rs942153 | 0.51 | 0.424658012 | 0.4734 |
| hCV29006006 | rs7034390 | hCV7577271 | rs1535655 | 0.51 | 0.424658012 | 0.4734 |
| hCV29006006 | rs7034390 | hCV7577287 | rs1323478 | 0.51 | 0.424658012 | 0.4989 |
| hCV29006006 | rs7034390 | hCV7577296 | rs1407910 | 0.51 | 0.424658012 | 0.4989 |
| hCV29006006 | rs7034390 | hCV7577311 | rs1323473 | 0.51 | 0.424658012 | 0.4466 |
| hCV29006006 | rs7034390 | hCV7577328 | rs1323476 | 0.51 | 0.424658012 | 0.4414 |
| hCV29006006 | rs7034390 | hCV7577332 | rs1468672 | 0.51 | 0.424658012 | 0.4414 |
| hCV29006006 | rs7034390 | hCV7577344 | rs876445 | 0.51 | 0.424658012 | 0.9666 |
| hCV29006006 | rs7034390 | hCV782872 | rs758958 | 0.51 | 0.424658012 | 0.4414 |
| hCV29824827 | rs9657673 | hCV11720383 | rs1951784 | 0.51 | 0.754211179 | 1 |
| hCV29824827 | rs9657673 | hCV11720402 | rs17611 | 0.51 | 0.754211179 | 0.9251 |
| hCV29824827 | rs9657673 | hCV15751718 | rs2296078 | 0.51 | 0.754211179 | 0.9628 |
| hCV29824827 | rs9657673 | hCV15755658 | rs2300934 | 0.51 | 0.754211179 | 0.8884 |
| hCV29824827 | rs9657673 | hCV16110109 | rs2078141 | 0.51 | 0.754211179 | 0.8177 |
| hCV29824827 | rs9657673 | hCV16234785 | rs2416811 | 0.51 | 0.754211179 | 0.9251 |
| hCV29824827 | rs9657673 | hCV1632190 | rs10760146 | 0.51 | 0.754211179 | 1 |
| hCV29824827 | rs9657673 | hCV2359571 | rs25681 | 0.51 | 0.754211179 | 0.9251 |
| hCV29824827 | rs9657673 | hCV25968825 | rs10818504 | 0.51 | 0.754211179 | 1 |
| hCV29824827 | rs9657673 | hCV26144282 | rs10818499 | 0.51 | 0.754211179 | 0.9251 |
| hCV29824827 | rs9657673 | hCV26144291 | rs4570235 | 0.51 | 0.754211179 | 0.9251 |
| hCV29824827 | rs9657673 | hCV26144296 | rs10760143 | 0.51 | 0.754211179 | 1 |
| hCV29824827 | rs9657673 | hCV27476319 | rs3747843 | 0.51 | 0.754211179 | 0.9628 |
| hCV29824827 | rs9657673 | hCV2783711 | rs10733650 | 0.51 | 0.754211179 | 0.925 |
| hCV29824827 | rs9657673 | hCV29005933 | rs7042135 | 0.51 | 0.754211179 | 0.8884 |
| hCV29824827 | rs9657673 | hCV29005936 | rs6478498 | 0.51 | 0.754211179 | 0.8884 |
| hCV29824827 | rs9657673 | hCV29734592 | rs10435889 | 0.51 | 0.754211179 | 0.9226 |
| hCV29824827 | rs9657673 | hCV30041036 | rs10156476 | 0.51 | 0.754211179 | 1 |
| hCV29824827 | rs9657673 | hCV30167357 | rs7022941 | 0.51 | 0.754211179 | 1 |
| hCV29824827 | rs9657673 | hCV3045797 | rs7036541 | 0.51 | 0.754211179 | 1 |
| hCV29824827 | rs9657673 | hCV3045800 | rs3736855 | 0.51 | 0.754211179 | 1 |
| hCV29824827 | rs9657673 | hCV3045804 | rs2057467 | 0.51 | 0.754211179 | 0.9467 |
| hCV29824827 | rs9657673 | hCV3045808 | rs10818516 | 0.51 | 0.754211179 | 0.9252 |
| hCV29824827 | rs9657673 | hCV3045810 | rs2209076 | 0.51 | 0.754211179 | 0.9274 |
| hCV29824827 | rs9657673 | hCV30830340 | rs10760134 | 0.51 | 0.754211179 | 0.8185 |
| hCV29824827 | rs9657673 | hCV30830341 | rs7040033 | 0.51 | 0.754211179 | 0.8185 |
| hCV29824827 | rs9657673 | hCV30830415 | rs7855998 | 0.51 | 0.754211179 | 0.8884 |
| hCV29824827 | rs9657673 | hCV30830427 | rs10760142 | 0.51 | 0.754211179 | 0.8884 |
| hCV29824827 | rs9657673 | hCV30830440 | rs10760144 | 0.51 | 0.754211179 | 1 |
| hCV29824827 | rs9657673 | hCV30830506 | rs10760151 | 0.51 | 0.754211179 | 1 |
| hCV29824827 | rs9657673 | hCV30830537 | rs10818515 | 0.51 | 0.754211179 | 0.9624 |
| hCV29824827 | rs9657673 | hCV30830539 | rs10760153 | 0.51 | 0.754211179 | 0.9621 |
| hCV29824827 | rs9657673 | hCV30830540 | rs10760154 | 0.51 | 0.754211179 | 0.9628 |
| hCV29824827 | rs9657673 | hCV30830541 | rs10760155 | 0.51 | 0.754211179 | 0.9628 |
| hCV29824827 | rs9657673 | hCV30830542 | rs10760156 | 0.51 | 0.754211179 | 0.9603 |
| hCV29824827 | rs9657673 | hCV7577235 | rs1052508 | 0.51 | 0.754211179 | 0.9628 |
| hCV29824827 | rs9657673 | hCV7577248 | rs1359086 | 0.51 | 0.754211179 | 0.9274 |
| hCV29824827 | rs9657673 | hCV7577249 | rs1359085 | 0.51 | 0.754211179 | 0.9628 |
| hCV29824827 | rs9657673 | hCV7577337 | rs993247 | 0.51 | 0.754211179 | 0.9251 |
| hCV30167357 | rs7022941 | hCV11720383 | rs1951784 | 0.51 | 0.885510667 | 1 |
| hCV30167357 | rs7022941 | hCV11720402 | rs17611 | 0.51 | 0.885510667 | 0.9642 |
| hCV30167357 | rs7022941 | hCV15751718 | rs2296078 | 0.51 | 0.885510667 | 0.9642 |
| hCV30167357 | rs7022941 | hCV15755658 | rs2300934 | 0.51 | 0.885510667 | 0.928 |
| hCV30167357 | rs7022941 | hCV16234785 | rs2416811 | 0.51 | 0.885510667 | 0.9642 |
| hCV30167357 | rs7022941 | hCV1632190 | rs10760146 | 0.51 | 0.885510667 | 1 |

TABLE 4-continued

| Interrogated SNP | Interrogated rs | LD SNP | LD SNP rs | Power | Threshold r² | r² |
|---|---|---|---|---|---|---|
| hCV30167357 | rs7022941 | hCV2359571 | rs25681 | 0.51 | 0.885510667 | 0.9642 |
| hCV30167357 | rs7022941 | hCV25968825 | rs10818504 | 0.51 | 0.885510667 | 1 |
| hCV30167357 | rs7022941 | hCV26144282 | rs10818499 | 0.51 | 0.885510667 | 0.9642 |
| hCV30167357 | rs7022941 | hCV26144291 | rs4570235 | 0.51 | 0.885510667 | 0.9642 |
| hCV30167357 | rs7022941 | hCV26144296 | rs10760143 | 0.51 | 0.885510667 | 1 |
| hCV30167357 | rs7022941 | hCV27476319 | rs3747843 | 0.51 | 0.885510667 | 0.9642 |
| hCV30167357 | rs7022941 | hCV2783711 | rs10733650 | 0.51 | 0.885510667 | 0.9642 |
| hCV30167357 | rs7022941 | hCV29005933 | rs7042135 | 0.51 | 0.885510667 | 0.928 |
| hCV30167357 | rs7022941 | hCV29005936 | rs6478498 | 0.51 | 0.885510667 | 0.928 |
| hCV30167357 | rs7022941 | hCV29734592 | rs10435889 | 0.51 | 0.885510667 | 0.9632 |
| hCV30167357 | rs7022941 | hCV29824827 | rs9657673 | 0.51 | 0.885510667 | 1 |
| hCV30167357 | rs7022941 | hCV30041036 | rs10156476 | 0.51 | 0.885510667 | 1 |
| hCV30167357 | rs7022941 | hCV3045797 | rs7036541 | 0.51 | 0.885510667 | 1 |
| hCV30167357 | rs7022941 | hCV3045800 | rs3736855 | 0.51 | 0.885510667 | 1 |
| hCV30167357 | rs7022941 | hCV3045804 | rs2057467 | 0.51 | 0.885510667 | 0.9467 |
| hCV30167357 | rs7022941 | hCV3045808 | rs10818516 | 0.51 | 0.885510667 | 0.928 |
| hCV30167357 | rs7022941 | hCV3045810 | rs2209076 | 0.51 | 0.885510667 | 0.9301 |
| hCV30167357 | rs7022941 | hCV30830415 | rs7855998 | 0.51 | 0.885510667 | 0.928 |
| hCV30167357 | rs7022941 | hCV30830427 | rs10760142 | 0.51 | 0.885510667 | 0.928 |
| hCV30167357 | rs7022941 | hCV30830440 | rs10760144 | 0.51 | 0.885510667 | 1 |
| hCV30167357 | rs7022941 | hCV30830506 | rs10760151 | 0.51 | 0.885510667 | 1 |
| hCV30167357 | rs7022941 | hCV30830537 | rs10818515 | 0.51 | 0.885510667 | 0.9639 |
| hCV30167357 | rs7022941 | hCV30830539 | rs10760153 | 0.51 | 0.885510667 | 0.9642 |
| hCV30167357 | rs7022941 | hCV30830540 | rs10760154 | 0.51 | 0.885510667 | 0.9642 |
| hCV30167357 | rs7022941 | hCV30830541 | rs10760155 | 0.51 | 0.885510667 | 0.9642 |
| hCV30167357 | rs7022941 | hCV30830542 | rs10760156 | 0.51 | 0.885510667 | 0.962 |
| hCV30167357 | rs7022941 | hCV7577235 | rs1052508 | 0.51 | 0.885510667 | 0.9642 |
| hCV30167357 | rs7022941 | hCV7577248 | rs1359086 | 0.51 | 0.885510667 | 0.9301 |
| hCV30167357 | rs7022941 | hCV7577249 | rs1359085 | 0.51 | 0.885510667 | 0.9642 |
| hCV30167357 | rs7022941 | hCV7577337 | rs993247 | 0.51 | 0.885510667 | 0.9642 |
| hCV3045797 | rs7036541 | hCV11720383 | rs1951784 | 0.51 | 0.968215659 | 1 |
| hCV3045797 | rs7036541 | hCV1632190 | rs10760146 | 0.51 | 0.968215659 | 1 |
| hCV3045797 | rs7036541 | hCV25968825 | rs10818504 | 0.51 | 0.968215659 | 1 |
| hCV3045797 | rs7036541 | hCV26144296 | rs10760143 | 0.51 | 0.968215659 | 1 |
| hCV3045797 | rs7036541 | hCV29824827 | rs9657673 | 0.51 | 0.968215659 | 1 |
| hCV3045797 | rs7036541 | hCV30041036 | rs10156476 | 0.51 | 0.968215659 | 1 |
| hCV3045797 | rs7036541 | hCV30167357 | rs7022941 | 0.51 | 0.968215659 | 1 |
| hCV3045797 | rs7036541 | hCV3045800 | rs3736855 | 0.51 | 0.968215659 | 1 |
| hCV3045797 | rs7036541 | hCV30830440 | rs10760144 | 0.51 | 0.968215659 | 1 |
| hCV3045797 | rs7036541 | hCV30830506 | rs10760151 | 0.51 | 0.968215659 | 1 |
| hCV30830506 | rs10760151 | hCV11720383 | rs1951784 | 0.51 | 0.852515741 | 1 |
| hCV30830506 | rs10760151 | hCV11720402 | rs17611 | 0.51 | 0.852515741 | 0.9293 |
| hCV30830506 | rs10760151 | hCV15751718 | rs2296078 | 0.51 | 0.852515741 | 0.9649 |
| hCV30830506 | rs10760151 | hCV15755658 | rs2300934 | 0.51 | 0.852515741 | 0.8947 |
| hCV30830506 | rs10760151 | hCV16234785 | rs2416811 | 0.51 | 0.852515741 | 0.9293 |
| hCV30830506 | rs10760151 | hCV1632190 | rs10760146 | 0.51 | 0.852515741 | 1 |
| hCV30830506 | rs10760151 | hCV2359571 | rs25681 | 0.51 | 0.852515741 | 0.9293 |
| hCV30830506 | rs10760151 | hCV25968825 | rs10818504 | 0.51 | 0.852515741 | 1 |
| hCV30830506 | rs10760151 | hCV26144282 | rs10818499 | 0.51 | 0.852515741 | 0.9293 |
| hCV30830506 | rs10760151 | hCV26144291 | rs4570235 | 0.51 | 0.852515741 | 0.9293 |
| hCV30830506 | rs10760151 | hCV26144296 | rs10760143 | 0.51 | 0.852515741 | 1 |
| hCV30830506 | rs10760151 | hCV27476319 | rs3747843 | 0.51 | 0.852515741 | 0.9649 |
| hCV30830506 | rs10760151 | hCV2783711 | rs10733650 | 0.51 | 0.852515741 | 0.9293 |
| hCV30830506 | rs10760151 | hCV29005933 | rs7042135 | 0.51 | 0.852515741 | 0.8947 |
| hCV30830506 | rs10760151 | hCV29005936 | rs6478498 | 0.51 | 0.852515741 | 0.8947 |
| hCV30830506 | rs10760151 | hCV29734592 | rs10435889 | 0.51 | 0.852515741 | 0.9272 |
| hCV30830506 | rs10760151 | hCV29824827 | rs9657673 | 0.51 | 0.852515741 | 1 |
| hCV30830506 | rs10760151 | hCV30041036 | rs10156476 | 0.51 | 0.852515741 | 1 |
| hCV30830506 | rs10760151 | hCV30167357 | rs7022941 | 0.51 | 0.852515741 | 1 |
| hCV30830506 | rs10760151 | hCV3045797 | rs7036541 | 0.51 | 0.852515741 | 1 |
| hCV30830506 | rs10760151 | hCV3045800 | rs3736855 | 0.51 | 0.852515741 | 1 |
| hCV30830506 | rs10760151 | hCV3045804 | rs2057467 | 0.51 | 0.852515741 | 0.9484 |
| hCV30830506 | rs10760151 | hCV3045808 | rs10818516 | 0.51 | 0.852515741 | 0.9294 |
| hCV30830506 | rs10760151 | hCV3045810 | rs2209076 | 0.51 | 0.852515741 | 0.9314 |
| hCV30830506 | rs10760151 | hCV30830415 | rs7855998 | 0.51 | 0.852515741 | 0.8947 |
| hCV30830506 | rs10760151 | hCV30830427 | rs10760142 | 0.51 | 0.852515741 | 0.8947 |
| hCV30830506 | rs10760151 | hCV30830440 | rs10760144 | 0.51 | 0.852515741 | 1 |
| hCV30830506 | rs10760151 | hCV30830537 | rs10818515 | 0.51 | 0.852515741 | 0.9646 |
| hCV30830506 | rs10760151 | hCV30830539 | rs10760153 | 0.51 | 0.852515741 | 0.9642 |
| hCV30830506 | rs10760151 | hCV30830540 | rs10760154 | 0.51 | 0.852515741 | 0.9649 |
| hCV30830506 | rs10760151 | hCV30830541 | rs10760155 | 0.51 | 0.852515741 | 0.9649 |
| hCV30830506 | rs10760151 | hCV30830542 | rs10760156 | 0.51 | 0.852515741 | 0.9628 |
| hCV30830506 | rs10760151 | hCV7577235 | rs1052508 | 0.51 | 0.852515741 | 0.9649 |
| hCV30830506 | rs10760151 | hCV7577248 | rs1359086 | 0.51 | 0.852515741 | 0.9314 |
| hCV30830506 | rs10760151 | hCV7577249 | rs1359085 | 0.51 | 0.852515741 | 0.9649 |
| hCV30830506 | rs10760151 | hCV7577337 | rs993247 | 0.51 | 0.852515741 | 0.9293 |
| hCV30830539 | rs10760153 | hCV11720383 | rs1951784 | 0.51 | 0.927552814 | 0.9642 |

TABLE 4-continued

| Interrogated SNP | Interrogated rs | LD SNP | LD SNP rs | Power | Threshold r² | r² |
|---|---|---|---|---|---|---|
| hCV30830539 | rs10760153 | hCV11720402 | rs17611 | 0.51 | 0.927552814 | 0.9287 |
| hCV30830539 | rs10760153 | hCV15751718 | rs2296078 | 0.51 | 0.927552814 | 1 |
| hCV30830539 | rs10760153 | hCV16234785 | rs2416811 | 0.51 | 0.927552814 | 0.9287 |
| hCV30830539 | rs10760153 | hCV1632190 | rs10760146 | 0.51 | 0.927552814 | 0.9642 |
| hCV30830539 | rs10760153 | hCV2359571 | rs25681 | 0.51 | 0.927552814 | 0.9287 |
| hCV30830539 | rs10760153 | hCV25968825 | rs10818504 | 0.51 | 0.927552814 | 0.9642 |
| hCV30830539 | rs10760153 | hCV26144282 | rs10818499 | 0.51 | 0.927552814 | 0.9287 |
| hCV30830539 | rs10760153 | hCV26144291 | rs4570235 | 0.51 | 0.927552814 | 0.9287 |
| hCV30830539 | rs10760153 | hCV26144296 | rs10760143 | 0.51 | 0.927552814 | 0.9635 |
| hCV30830539 | rs10760153 | hCV27476319 | rs3747843 | 0.51 | 0.927552814 | 0.9287 |
| hCV30830539 | rs10760153 | hCV2783711 | rs10733650 | 0.51 | 0.927552814 | 0.9286 |
| hCV30830539 | rs10760153 | hCV29824827 | rs9657673 | 0.51 | 0.927552814 | 0.9621 |
| hCV30830539 | rs10760153 | hCV30041036 | rs10156476 | 0.51 | 0.927552814 | 0.9639 |
| hCV30830539 | rs10760153 | hCV30167357 | rs7022941 | 0.51 | 0.927552814 | 0.9642 |
| hCV30830539 | rs10760153 | hCV3045797 | rs7036541 | 0.51 | 0.927552814 | 0.9632 |
| hCV30830539 | rs10760153 | hCV3045800 | rs3736855 | 0.51 | 0.927552814 | 0.9642 |
| hCV30830539 | rs10760153 | hCV3045808 | rs10818516 | 0.51 | 0.927552814 | 0.9635 |
| hCV30830539 | rs10760153 | hCV3045810 | rs2209076 | 0.51 | 0.927552814 | 0.9646 |
| hCV30830539 | rs10760153 | hCV30830440 | rs10760144 | 0.51 | 0.927552814 | 0.9642 |
| hCV30830539 | rs10760153 | hCV30830506 | rs10760151 | 0.51 | 0.927552814 | 0.9642 |
| hCV30830539 | rs10760153 | hCV30830537 | rs10818515 | 0.51 | 0.927552814 | 1 |
| hCV30830539 | rs10760153 | hCV30830540 | rs10760154 | 0.51 | 0.927552814 | 1 |
| hCV30830539 | rs10760153 | hCV30830541 | rs10760155 | 0.51 | 0.927552814 | 1 |
| hCV30830539 | rs10760153 | hCV30830542 | rs10760156 | 0.51 | 0.927552814 | 1 |
| hCV30830539 | rs10760153 | hCV7577235 | rs1052508 | 0.51 | 0.927552814 | 1 |
| hCV30830539 | rs10760153 | hCV7577248 | rs1359086 | 0.51 | 0.927552814 | 0.9646 |
| hCV30830539 | rs10760153 | hCV7577249 | rs1359085 | 0.51 | 0.927552814 | 1 |
| hCV30830539 | rs10760153 | hCV7577337 | rs993247 | 0.51 | 0.927552814 | 0.9287 |
| hCV30830638 | rs10985073 | hCV11266229 | rs10435844 | 0.51 | 0.367429713 | 0.6467 |
| hCV30830638 | rs10985073 | hCV11266268 | rs10760121 | 0.51 | 0.367429713 | 0.6691 |
| hCV30830638 | rs10985073 | hCV11720351 | rs1885995 | 0.51 | 0.367429713 | 0.4963 |
| hCV30830638 | rs10985073 | hCV11720413 | rs1930782 | 0.51 | 0.367429713 | 0.9671 |
| hCV30830638 | rs10985073 | hCV11720414 | rs1930781 | 0.51 | 0.367429713 | 0.6467 |
| hCV30830638 | rs10985073 | hCV1452630 | rs10818476 | 0.51 | 0.367429713 | 0.3756 |
| hCV30830638 | rs10985073 | hCV1452665 | rs4837796 | 0.51 | 0.367429713 | 0.3756 |
| hCV30830638 | rs10985073 | hCV15751717 | rs2296077 | 0.51 | 0.367429713 | 0.4374 |
| hCV30830638 | rs10985073 | hCV15751719 | rs2146838 | 0.51 | 0.367429713 | 0.4963 |
| hCV30830638 | rs10985073 | hCV15757738 | rs2302498 | 0.51 | 0.367429713 | 0.4505 |
| hCV30830638 | rs10985073 | hCV15849116 | rs2900180 | 0.51 | 0.367429713 | 0.6342 |
| hCV30830638 | rs10985073 | hCV15870898 | rs2072438 | 0.51 | 0.367429713 | 1 |
| hCV30830638 | rs10985073 | hCV16124825 | rs2109895 | 0.51 | 0.367429713 | 0.6467 |
| hCV30830638 | rs10985073 | hCV16175379 | rs2239657 | 0.51 | 0.367429713 | 0.625 |
| hCV30830638 | rs10985073 | hCV16234795 | rs2416804 | 0.51 | 0.367429713 | 0.9353 |
| hCV30830638 | rs10985073 | hCV1761888 | rs1953126 | 0.51 | 0.367429713 | 0.6691 |
| hCV30830638 | rs10985073 | hCV1761891 | rs1930778 | 0.51 | 0.367429713 | 0.6222 |
| hCV30830638 | rs10985073 | hCV1761894 | rs1609810 | 0.51 | 0.367429713 | 0.6485 |
| hCV30830638 | rs10985073 | hCV22272588 | rs10760117 | 0.51 | 0.367429713 | 0.3756 |
| hCV30830638 | rs10985073 | hCV2359565 | rs1014530 | 0.51 | 0.367429713 | 0.9671 |
| hCV30830638 | rs10985073 | hCV25751916 | rs10985070 | 0.51 | 0.367429713 | 1 |
| hCV30830638 | rs10985073 | hCV26144307 | rs1016468 | 0.51 | 0.367429713 | 0.4963 |
| hCV30830638 | rs10985073 | hCV26144332 | rs4837813 | 0.51 | 0.367429713 | 0.4761 |
| hCV30830638 | rs10985073 | hCV2783582 | rs10818482 | 0.51 | 0.367429713 | 1 |
| hCV30830638 | rs10985073 | hCV2783586 | rs2270231 | 0.51 | 0.367429713 | 0.6691 |
| hCV30830638 | rs10985073 | hCV2783589 | rs881375 | 0.51 | 0.367429713 | 0.6691 |
| hCV30830638 | rs10985073 | hCV2783590 | rs6478486 | 0.51 | 0.367429713 | 0.6691 |
| hCV30830638 | rs10985073 | hCV2783591 | rs1468671 | 0.51 | 0.367429713 | 0.6467 |
| hCV30830638 | rs10985073 | hCV2783593 | rs1548783 | 0.51 | 0.367429713 | 0.6423 |
| hCV30830638 | rs10985073 | hCV2783597 | rs1860824 | 0.51 | 0.367429713 | 0.6357 |
| hCV30830638 | rs10985073 | hCV2783599 | rs7046108 | 0.51 | 0.367429713 | 0.6467 |
| hCV30830638 | rs10985073 | hCV2783604 | rs10760126 | 0.51 | 0.367429713 | 0.9666 |
| hCV30830638 | rs10985073 | hCV2783607 | rs9886724 | 0.51 | 0.367429713 | 1 |
| hCV30830638 | rs10985073 | hCV2783608 | rs4836834 | 0.51 | 0.367429713 | 0.9671 |
| hCV30830638 | rs10985073 | hCV2783609 | rs2241003 | 0.51 | 0.367429713 | 0.7074 |
| hCV30830638 | rs10985073 | hCV2783611 | rs10435843 | 0.51 | 0.367429713 | 0.6467 |
| hCV30830638 | rs10985073 | hCV2783618 | rs2239658 | 0.51 | 0.367429713 | 0.6467 |
| hCV30830638 | rs10985073 | hCV2783620 | rs7021880 | 0.51 | 0.367429713 | 0.5878 |
| hCV30830638 | rs10985073 | hCV2783621 | rs2416805 | 0.51 | 0.367429713 | 0.6467 |
| hCV30830638 | rs10985073 | hCV2783622 | rs758959 | 0.51 | 0.367429713 | 0.6467 |
| hCV30830638 | rs10985073 | hCV2783625 | rs10118357 | 0.51 | 0.367429713 | 0.9665 |
| hCV30830638 | rs10985073 | hCV2783630 | rs2269060 | 0.51 | 0.367429713 | 0.9671 |
| hCV30830638 | rs10985073 | hCV2783633 | rs7021049 | 0.51 | 0.367429713 | 0.9671 |
| hCV30830638 | rs10985073 | hCV2783634 | rs1014529 | 0.51 | 0.367429713 | 0.6467 |
| hCV30830638 | rs10985073 | hCV2783635 | rs1930780 | 0.51 | 0.367429713 | 0.6467 |
| hCV30830638 | rs10985073 | hCV2783638 | rs3761846 | 0.51 | 0.367429713 | 0.9671 |
| hCV30830638 | rs10985073 | hCV2783640 | rs3761847 | 0.51 | 0.367429713 | 0.9353 |
| hCV30830638 | rs10985073 | hCV2783641 | rs2416806 | 0.51 | 0.367429713 | 0.6594 |
| hCV30830638 | rs10985073 | hCV2783647 | rs10739580 | 0.51 | 0.367429713 | 0.6467 |

TABLE 4-continued

| Interrogated SNP | Interrogated rs | LD SNP | LD SNP rs | Power | Threshold r² | r² |
|---|---|---|---|---|---|---|
| hCV30830638 | rs10985073 | hCV2783650 | rs10760129 | 0.51 | 0.367429713 | 0.9671 |
| hCV30830638 | rs10985073 | hCV2783653 | rs10760130 | 0.51 | 0.367429713 | 0.9671 |
| hCV30830638 | rs10985073 | hCV2783655 | rs10818488 | 0.51 | 0.367429713 | 0.9671 |
| hCV30830638 | rs10985073 | hCV2783656 | rs4837804 | 0.51 | 0.367429713 | 0.7472 |
| hCV30830638 | rs10985073 | hCV2783659 | rs7039505 | 0.51 | 0.367429713 | 0.6319 |
| hCV30830638 | rs10985073 | hCV2783711 | rs10733650 | 0.51 | 0.367429713 | 0.3903 |
| hCV30830638 | rs10985073 | hCV2783718 | rs10818500 | 0.51 | 0.367429713 | 0.6972 |
| hCV30830638 | rs10985073 | hCV29005955 | rs7036980 | 0.51 | 0.367429713 | 0.4304 |
| hCV30830638 | rs10985073 | hCV29005976 | rs7037195 | 0.51 | 0.367429713 | 0.9671 |
| hCV30830638 | rs10985073 | hCV29005978 | rs7021206 | 0.51 | 0.367429713 | 0.6788 |
| hCV30830638 | rs10985073 | hCV29006006 | rs7034390 | 0.51 | 0.367429713 | 0.6691 |
| hCV30830638 | rs10985073 | hCV29879049 | rs9792437 | 0.51 | 0.367429713 | 0.4711 |
| hCV30830638 | rs10985073 | hCV3045812 | rs7030849 | 0.51 | 0.367429713 | 0.4711 |
| hCV30830638 | rs10985073 | hCV30830319 | rs7037673 | 0.51 | 0.367429713 | 0.5359 |
| hCV30830638 | rs10985073 | hCV30830325 | rs10818494 | 0.51 | 0.367429713 | 0.4346 |
| hCV30830638 | rs10985073 | hCV30830340 | rs10760134 | 0.51 | 0.367429713 | 0.4135 |
| hCV30830638 | rs10985073 | hCV30830341 | rs7040033 | 0.51 | 0.367429713 | 0.4135 |
| hCV30830638 | rs10985073 | hCV30830419 | rs10985140 | 0.51 | 0.367429713 | 0.6598 |
| hCV30830638 | rs10985073 | hCV30830474 | rs10739590 | 0.51 | 0.367429713 | 0.5521 |
| hCV30830638 | rs10985073 | hCV30830725 | rs7864019 | 0.51 | 0.367429713 | 0.6467 |
| hCV30830638 | rs10985073 | hCV30830832 | rs10733648 | 0.51 | 0.367429713 | 0.6467 |
| hCV30830638 | rs10985073 | hCV30830909 | rs11794516 | 0.51 | 0.367429713 | 1 |
| hCV30830638 | rs10985073 | hCV7577254 | rs942152 | 0.51 | 0.367429713 | 0.4017 |
| hCV30830638 | rs10985073 | hCV7577317 | rs1323472 | 0.51 | 0.367429713 | 0.6896 |
| hCV30830638 | rs10985073 | hCV7577331 | rs1468673 | 0.51 | 0.367429713 | 0.6896 |
| hCV30830638 | rs10985073 | hCV7577344 | rs876445 | 0.51 | 0.367429713 | 0.6467 |
| hCV30830638 | rs10985073 | hCV782875 | rs746182 | 0.51 | 0.367429713 | 0.4761 |
| hCV30830641 | rs4837839 | hCV11266055 | rs4837823 | 0.51 | 0.518235842 | 0.8961 |
| hCV30830641 | rs4837839 | hCV11493945 | rs1865542 | 0.51 | 0.518235842 | 0.8942 |
| hCV30830641 | rs4837839 | hCV11840647 | rs10985194 | 0.51 | 0.518235842 | 0.8961 |
| hCV30830641 | rs4837839 | hCV1219008 | rs7028970 | 0.51 | 0.518235842 | 0.8923 |
| hCV30830641 | rs4837839 | hCV1219009 | rs3747850 | 0.51 | 0.518235842 | 0.8961 |
| hCV30830641 | rs4837839 | hCV1219010 | rs7870797 | 0.51 | 0.518235842 | 0.8896 |
| hCV30830641 | rs4837839 | hCV1219011 | rs3761856 | 0.51 | 0.518235842 | 0.7553 |
| hCV30830641 | rs4837839 | hCV1219013 | rs10760169 | 0.51 | 0.518235842 | 0.8961 |
| hCV30830641 | rs4837839 | hCV1219014 | rs4837832 | 0.51 | 0.518235842 | 0.8961 |
| hCV30830641 | rs4837839 | hCV1219022 | rs880823 | 0.51 | 0.518235842 | 0.8139 |
| hCV30830641 | rs4837839 | hCV1219023 | rs878691 | 0.51 | 0.518235842 | 0.8961 |
| hCV30830641 | rs4837839 | hCV1219024 | rs10760167 | 0.51 | 0.518235842 | 0.8948 |
| hCV30830641 | rs4837839 | hCV1219026 | rs963003 | 0.51 | 0.518235842 | 0.8961 |
| hCV30830641 | rs4837839 | hCV1219027 | rs10818524 | 0.51 | 0.518235842 | 0.8961 |
| hCV30830641 | rs4837839 | hCV1219038 | rs10760159 | 0.51 | 0.518235842 | 0.8961 |
| hCV30830641 | rs4837839 | hCV1219040 | rs10985188 | 0.51 | 0.518235842 | 0.8961 |
| hCV30830641 | rs4837839 | hCV1219042 | rs7865779 | 0.51 | 0.518235842 | 0.8961 |
| hCV30830641 | rs4837839 | hCV1219043 | rs10760161 | 0.51 | 0.518235842 | 0.9293 |
| hCV30830641 | rs4837839 | hCV1219044 | rs10818517 | 0.51 | 0.518235842 | 0.9293 |
| hCV30830641 | rs4837839 | hCV1434290 | rs2416829 | 0.51 | 0.518235842 | 0.6292 |
| hCV30830641 | rs4837839 | hCV15830840 | rs2149805 | 0.51 | 0.518235842 | 0.8961 |
| hCV30830641 | rs4837839 | hCV25988184 | rs10985200 | 0.51 | 0.518235842 | 0.8829 |
| hCV30830641 | rs4837839 | hCV26144347 | rs10760158 | 0.51 | 0.518235842 | 0.7446 |
| hCV30830641 | rs4837839 | hCV26144352 | rs10760160 | 0.51 | 0.518235842 | 0.8942 |
| hCV30830641 | rs4837839 | hCV26144367 | rs3827678 | 0.51 | 0.518235842 | 0.8522 |
| hCV30830641 | rs4837839 | hCV26144368 | rs4836845 | 0.51 | 0.518235842 | 0.8888 |
| hCV30830641 | rs4837839 | hCV27492705 | rs3810942 | 0.51 | 0.518235842 | 0.8961 |
| hCV30830641 | rs4837839 | hCV27912354 | rs4836847 | 0.51 | 0.518235842 | 0.8942 |
| hCV30830641 | rs4837839 | hCV27912355 | rs4837834 | 0.51 | 0.518235842 | 0.7919 |
| hCV30830641 | rs4837839 | hCV27967328 | rs4836848 | 0.51 | 0.518235842 | 0.8961 |
| hCV30830641 | rs4837839 | hCV27988905 | rs4836843 | 0.51 | 0.518235842 | 0.8961 |
| hCV30830641 | rs4837839 | hCV28010799 | rs4240466 | 0.51 | 0.518235842 | 0.8948 |
| hCV30830641 | rs4837839 | hCV28010800 | rs4837827 | 0.51 | 0.518235842 | 0.8961 |
| hCV30830641 | rs4837839 | hCV28032606 | rs4837818 | 0.51 | 0.518235842 | 0.8961 |
| hCV30830641 | rs4837839 | hCV28032607 | rs4556152 | 0.51 | 0.518235842 | 0.8942 |
| hCV30830641 | rs4837839 | hCV28032608 | rs4837835 | 0.51 | 0.518235842 | 0.8961 |
| hCV30830641 | rs4837839 | hCV2973085 | rs10818523 | 0.51 | 0.518235842 | 0.8961 |
| hCV30830641 | rs4837839 | hCV2973086 | rs10513365 | 0.51 | 0.518235842 | 0.8961 |
| hCV30830641 | rs4837839 | hCV30830586 | rs10760162 | 0.51 | 0.518235842 | 0.8223 |
| hCV30830641 | rs4837839 | hCV30830588 | rs4837819 | 0.51 | 0.518235842 | 0.8961 |
| hCV30830641 | rs4837839 | hCV30830589 | rs10760163 | 0.51 | 0.518235842 | 0.8961 |
| hCV30830641 | rs4837839 | hCV30830590 | rs4837820 | 0.51 | 0.518235842 | 0.8961 |
| hCV30830641 | rs4837839 | hCV30830591 | rs10760164 | 0.51 | 0.518235842 | 0.8942 |
| hCV30830641 | rs4837839 | hCV30830597 | rs4836842 | 0.51 | 0.518235842 | 0.8961 |
| hCV30830641 | rs4837839 | hCV30830606 | rs10739593 | 0.51 | 0.518235842 | 0.8961 |
| hCV30830641 | rs4837839 | hCV30830607 | rs10760165 | 0.51 | 0.518235842 | 0.8961 |
| hCV30830641 | rs4837839 | hCV30830609 | rs4837826 | 0.51 | 0.518235842 | 0.8961 |
| hCV30830641 | rs4837839 | hCV30830616 | rs13292100 | 0.51 | 0.518235842 | 0.8619 |
| hCV30830641 | rs4837839 | hCV578200 | rs767769 | 0.51 | 0.518235842 | 0.6913 |
| hCV30830641 | rs4837839 | hCV7577193 | rs913763 | 0.51 | 0.518235842 | 0.8961 |

TABLE 4-continued

| Interrogated SNP | Interrogated rs | LD SNP | LD SNP rs | Power | Threshold r² | r² |
|---|---|---|---|---|---|---|
| hCV30830641 | rs4837839 | hCV8605563 | rs10739594 | 0.51 | 0.518235842 | 0.8961 |
| hCV30830725 | rs7864019 | hCV11266229 | rs10435844 | 0.51 | 0.424658012 | 1 |
| hCV30830725 | rs7864019 | hCV11266268 | rs10760121 | 0.51 | 0.424658012 | 0.9666 |
| hCV30830725 | rs7864019 | hCV11720350 | rs2057469 | 0.51 | 0.424658012 | 0.4465 |
| hCV30830725 | rs7864019 | hCV11720413 | rs1930782 | 0.51 | 0.424658012 | 0.6687 |
| hCV30830725 | rs7864019 | hCV11720414 | rs1930781 | 0.51 | 0.424658012 | 1 |
| hCV30830725 | rs7864019 | hCV15849105 | rs2900185 | 0.51 | 0.424658012 | 0.4708 |
| hCV30830725 | rs7864019 | hCV15849116 | rs2900180 | 0.51 | 0.424658012 | 1 |
| hCV30830725 | rs7864019 | hCV15870898 | rs2072438 | 0.51 | 0.424658012 | 0.6467 |
| hCV30830725 | rs7864019 | hCV16124825 | rs2109895 | 0.51 | 0.424658012 | 1 |
| hCV30830725 | rs7864019 | hCV16175379 | rs2239657 | 0.51 | 0.424658012 | 0.9664 |
| hCV30830725 | rs7864019 | hCV16234795 | rs2416804 | 0.51 | 0.424658012 | 0.6341 |
| hCV30830725 | rs7864019 | hCV16234838 | rs2416819 | 0.51 | 0.424658012 | 0.4465 |
| hCV30830725 | rs7864019 | hCV16234840 | rs2416817 | 0.51 | 0.424658012 | 0.4708 |
| hCV30830725 | rs7864019 | hCV1632195 | rs1998505 | 0.51 | 0.424658012 | 0.4708 |
| hCV30830725 | rs7864019 | hCV1761888 | rs1953126 | 0.51 | 0.424658012 | 0.9666 |
| hCV30830725 | rs7864019 | hCV1761891 | rs1930778 | 0.51 | 0.424658012 | 0.9602 |
| hCV30830725 | rs7864019 | hCV1761894 | rs1609810 | 0.51 | 0.424658012 | 0.9609 |
| hCV30830725 | rs7864019 | hCV2359565 | rs1014530 | 0.51 | 0.424658012 | 0.6687 |
| hCV30830725 | rs7864019 | hCV25613469 | rs10760157 | 0.51 | 0.424658012 | 0.4465 |
| hCV30830725 | rs7864019 | hCV25751916 | rs10985070 | 0.51 | 0.424658012 | 0.6467 |
| hCV30830725 | rs7864019 | hCV25771057 | rs10760150 | 0.51 | 0.424658012 | 0.4708 |
| hCV30830725 | rs7864019 | hCV2783582 | rs10818482 | 0.51 | 0.424658012 | 0.6467 |
| hCV30830725 | rs7864019 | hCV2783586 | rs2270231 | 0.51 | 0.424658012 | 0.9666 |
| hCV30830725 | rs7864019 | hCV2783589 | rs881375 | 0.51 | 0.424658012 | 0.9666 |
| hCV30830725 | rs7864019 | hCV2783590 | rs6478486 | 0.51 | 0.424658012 | 0.9666 |
| hCV30830725 | rs7864019 | hCV2783591 | rs1468671 | 0.51 | 0.424658012 | 1 |
| hCV30830725 | rs7864019 | hCV2783593 | rs1548783 | 0.51 | 0.424658012 | 1 |
| hCV30830725 | rs7864019 | hCV2783597 | rs1860824 | 0.51 | 0.424658012 | 1 |
| hCV30830725 | rs7864019 | hCV2783599 | rs7046108 | 0.51 | 0.424658012 | 1 |
| hCV30830725 | rs7864019 | hCV2783604 | rs10760126 | 0.51 | 0.424658012 | 0.6875 |
| hCV30830725 | rs7864019 | hCV2783607 | rs9886724 | 0.51 | 0.424658012 | 0.6785 |
| hCV30830725 | rs7864019 | hCV2783608 | rs4836834 | 0.51 | 0.424658012 | 0.6687 |
| hCV30830725 | rs7864019 | hCV2783609 | rs2241003 | 0.51 | 0.424658012 | 0.9321 |
| hCV30830725 | rs7864019 | hCV2783611 | rs10435843 | 0.51 | 0.424658012 | 1 |
| hCV30830725 | rs7864019 | hCV2783618 | rs2239658 | 0.51 | 0.424658012 | 1 |
| hCV30830725 | rs7864019 | hCV2783620 | rs7021880 | 0.51 | 0.424658012 | 0.9301 |
| hCV30830725 | rs7864019 | hCV2783621 | rs2416805 | 0.51 | 0.424658012 | 1 |
| hCV30830725 | rs7864019 | hCV2783622 | rs758959 | 0.51 | 0.424658012 | 1 |
| hCV30830725 | rs7864019 | hCV2783625 | rs10118357 | 0.51 | 0.424658012 | 0.6645 |
| hCV30830725 | rs7864019 | hCV2783630 | rs2269060 | 0.51 | 0.424658012 | 0.6687 |
| hCV30830725 | rs7864019 | hCV2783633 | rs7021049 | 0.51 | 0.424658012 | 0.6687 |
| hCV30830725 | rs7864019 | hCV2783634 | rs1014529 | 0.51 | 0.424658012 | 1 |
| hCV30830725 | rs7864019 | hCV2783635 | rs1930780 | 0.51 | 0.424658012 | 1 |
| hCV30830725 | rs7864019 | hCV2783638 | rs3761846 | 0.51 | 0.424658012 | 0.6687 |
| hCV30830725 | rs7864019 | hCV2783640 | rs3761847 | 0.51 | 0.424658012 | 0.6341 |
| hCV30830725 | rs7864019 | hCV2783641 | rs2416806 | 0.51 | 0.424658012 | 1 |
| hCV30830725 | rs7864019 | hCV2783647 | rs10739580 | 0.51 | 0.424658012 | 1 |
| hCV30830725 | rs7864019 | hCV2783650 | rs10760129 | 0.51 | 0.424658012 | 0.6687 |
| hCV30830725 | rs7864019 | hCV2783653 | rs10760130 | 0.51 | 0.424658012 | 0.6687 |
| hCV30830725 | rs7864019 | hCV2783655 | rs10818488 | 0.51 | 0.424658012 | 0.6687 |
| hCV30830725 | rs7864019 | hCV2783656 | rs4837804 | 0.51 | 0.424658012 | 0.8956 |
| hCV30830725 | rs7864019 | hCV2783659 | rs7039505 | 0.51 | 0.424658012 | 1 |
| hCV30830725 | rs7864019 | hCV27912350 | rs4837808 | 0.51 | 0.424658012 | 0.4708 |
| hCV30830725 | rs7864019 | hCV27912351 | rs4837809 | 0.51 | 0.424658012 | 0.4708 |
| hCV30830725 | rs7864019 | hCV29005924 | rs7031128 | 0.51 | 0.424658012 | 0.4264 |
| hCV30830725 | rs7864019 | hCV29005976 | rs7037195 | 0.51 | 0.424658012 | 0.6687 |
| hCV30830725 | rs7864019 | hCV29005978 | rs7021206 | 0.51 | 0.424658012 | 1 |
| hCV30830725 | rs7864019 | hCV29006006 | rs7034390 | 0.51 | 0.424658012 | 0.9666 |
| hCV30830725 | rs7864019 | hCV30059070 | rs10156413 | 0.51 | 0.424658012 | 0.5258 |
| hCV30830725 | rs7864019 | hCV3045792 | rs6478499 | 0.51 | 0.424658012 | 0.4879 |
| hCV30830725 | rs7864019 | hCV3045801 | rs2057465 | 0.51 | 0.424658012 | 0.4332 |
| hCV30830725 | rs7864019 | hCV30563729 | rs9299273 | 0.51 | 0.424658012 | 0.4708 |
| hCV30830725 | rs7864019 | hCV30830468 | rs10818507 | 0.51 | 0.424658012 | 0.4539 |
| hCV30830725 | rs7864019 | hCV30830473 | rs7036649 | 0.51 | 0.424658012 | 0.4705 |
| hCV30830725 | rs7864019 | hCV30830475 | rs10733652 | 0.51 | 0.424658012 | 0.4269 |
| hCV30830725 | rs7864019 | hCV30830484 | rs10818508 | 0.51 | 0.424658012 | 0.4708 |
| hCV30830725 | rs7864019 | hCV30830486 | rs10760149 | 0.51 | 0.424658012 | 0.4708 |
| hCV30830725 | rs7864019 | hCV30830503 | rs4837811 | 0.51 | 0.424658012 | 0.4708 |
| hCV30830725 | rs7864019 | hCV30830512 | rs10818512 | 0.51 | 0.424658012 | 0.4465 |
| hCV30830725 | rs7864019 | hCV30830521 | rs10818513 | 0.51 | 0.424658012 | 0.4465 |
| hCV30830725 | rs7864019 | hCV30830536 | rs7047038 | 0.51 | 0.424658012 | 0.4465 |
| hCV30830725 | rs7864019 | hCV30830638 | rs10985073 | 0.51 | 0.424658012 | 0.6467 |
| hCV30830725 | rs7864019 | hCV30830832 | rs10733648 | 0.51 | 0.424658012 | 1 |
| hCV30830725 | rs7864019 | hCV30830909 | rs11794516 | 0.51 | 0.424658012 | 0.6467 |
| hCV30830725 | rs7864019 | hCV7577250 | rs942153 | 0.51 | 0.424658012 | 0.4465 |
| hCV30830725 | rs7864019 | hCV7577271 | rs1535655 | 0.51 | 0.424658012 | 0.4465 |

TABLE 4-continued

| Interrogated SNP | Interrogated rs | LD SNP | LD SNP rs | Power | Threshold r² | r² |
|---|---|---|---|---|---|---|
| hCV30830725 | rs7864019 | hCV7577287 | rs1323478 | 0.51 | 0.424658012 | 0.4708 |
| hCV30830725 | rs7864019 | hCV7577296 | rs1407910 | 0.51 | 0.424658012 | 0.4708 |
| hCV30830725 | rs7864019 | hCV7577344 | rs876445 | 0.51 | 0.424658012 | 1 |
| hCV7577317 | rs1323472 | hCV11720351 | rs1885995 | 0.51 | 0.765562317 | 0.78 |
| hCV7577317 | rs1323472 | hCV15751719 | rs2146838 | 0.51 | 0.765562317 | 0.78 |
| hCV7577317 | rs1323472 | hCV26144307 | rs1016468 | 0.51 | 0.765562317 | 0.78 |
| hCV7577317 | rs1323472 | hCV2783718 | rs10818500 | 0.51 | 0.765562317 | 1 |
| hCV7577317 | rs1323472 | hCV30830419 | rs10985140 | 0.51 | 0.765562317 | 0.9672 |
| hCV7577317 | rs1323472 | hCV30830474 | rs10739590 | 0.51 | 0.765562317 | 0.7677 |
| hCV7577317 | rs1323472 | hCV7577331 | rs1468673 | 0.51 | 0.765562317 | 1 |
| hCV7577337 | rs993247 | hCV11720383 | rs1951784 | 0.51 | 0.888308233 | 0.9293 |
| hCV7577337 | rs993247 | hCV11720402 | rs17611 | 0.51 | 0.888308233 | 1 |
| hCV7577337 | rs993247 | hCV15751718 | rs2296078 | 0.51 | 0.888308233 | 0.8957 |
| hCV7577337 | rs993247 | hCV15755658 | rs2300934 | 0.51 | 0.888308233 | 0.9646 |
| hCV7577337 | rs993247 | hCV16234785 | rs2416811 | 0.51 | 0.888308233 | 1 |
| hCV7577337 | rs993247 | hCV1632190 | rs10760146 | 0.51 | 0.888308233 | 0.9293 |
| hCV7577337 | rs993247 | hCV2359571 | rs25681 | 0.51 | 0.888308233 | 1 |
| hCV7577337 | rs993247 | hCV25968825 | rs10818504 | 0.51 | 0.888308233 | 0.9293 |
| hCV7577337 | rs993247 | hCV26144282 | rs10818499 | 0.51 | 0.888308233 | 1 |
| hCV7577337 | rs993247 | hCV26144291 | rs4570235 | 0.51 | 0.888308233 | 1 |
| hCV7577337 | rs993247 | hCV26144296 | rs10760143 | 0.51 | 0.888308233 | 0.9279 |
| hCV7577337 | rs993247 | hCV27476319 | rs3747843 | 0.51 | 0.888308233 | 0.8957 |
| hCV7577337 | rs993247 | hCV2783711 | rs10733650 | 0.51 | 0.888308233 | 1 |
| hCV7577337 | rs993247 | hCV29005933 | rs7042135 | 0.51 | 0.888308233 | 0.9646 |
| hCV7577337 | rs993247 | hCV29005936 | rs6478498 | 0.51 | 0.888308233 | 0.9646 |
| hCV7577337 | rs993247 | hCV29734592 | rs10435889 | 0.51 | 0.888308233 | 1 |
| hCV7577337 | rs993247 | hCV29824827 | rs9657673 | 0.51 | 0.888308233 | 0.9251 |
| hCV7577337 | rs993247 | hCV30041036 | rs10156476 | 0.51 | 0.888308233 | 0.9286 |
| hCV7577337 | rs993247 | hCV30167357 | rs7022941 | 0.51 | 0.888308233 | 0.9642 |
| hCV7577337 | rs993247 | hCV3045797 | rs7036541 | 0.51 | 0.888308233 | 0.9272 |
| hCV7577337 | rs993247 | hCV3045800 | rs3736855 | 0.51 | 0.888308233 | 0.9293 |
| hCV7577337 | rs993247 | hCV30830340 | rs10760134 | 0.51 | 0.888308233 | 0.8956 |
| hCV7577337 | rs993247 | hCV30830341 | rs7040033 | 0.51 | 0.888308233 | 0.8956 |
| hCV7577337 | rs993247 | hCV30830415 | rs7855998 | 0.51 | 0.888308233 | 0.9646 |
| hCV7577337 | rs993247 | hCV30830427 | rs10760142 | 0.51 | 0.888308233 | 0.9646 |
| hCV7577337 | rs993247 | hCV30830440 | rs10760144 | 0.51 | 0.888308233 | 0.9293 |
| hCV7577337 | rs993247 | hCV30830506 | rs10760151 | 0.51 | 0.888308233 | 0.9293 |
| hCV7577337 | rs993247 | hCV30830537 | rs10818515 | 0.51 | 0.888308233 | 0.8946 |
| hCV7577337 | rs993247 | hCV30830539 | rs10760153 | 0.51 | 0.888308233 | 0.9287 |
| hCV7577337 | rs993247 | hCV30830540 | rs10760154 | 0.51 | 0.888308233 | 0.8956 |
| hCV7577337 | rs993247 | hCV30830541 | rs10760155 | 0.51 | 0.888308233 | 0.8957 |
| hCV7577337 | rs993247 | hCV30830542 | rs10760156 | 0.51 | 0.888308233 | 0.8894 |
| hCV7577337 | rs993247 | hCV7577235 | rs1052508 | 0.51 | 0.888308233 | 0.8957 |
| hCV7577337 | rs993247 | hCV7577249 | rs1359085 | 0.51 | 0.888308233 | 0.8957 |
| hCV7577344 | rs876445 | hCV11266229 | rs10435844 | 0.51 | 0.411716825 | 1 |
| hCV7577344 | rs876445 | hCV11266268 | rs10760121 | 0.51 | 0.411716825 | 0.9666 |
| hCV7577344 | rs876445 | hCV11720350 | rs2057469 | 0.51 | 0.411716825 | 0.4465 |
| hCV7577344 | rs876445 | hCV11720413 | rs1930782 | 0.51 | 0.411716825 | 0.6687 |
| hCV7577344 | rs876445 | hCV11720414 | rs1930781 | 0.51 | 0.411716825 | 1 |
| hCV7577344 | rs876445 | hCV15849105 | rs2900185 | 0.51 | 0.411716825 | 0.4708 |
| hCV7577344 | rs876445 | hCV15849116 | rs2900180 | 0.51 | 0.411716825 | 1 |
| hCV7577344 | rs876445 | hCV15870898 | rs2072438 | 0.51 | 0.411716825 | 0.6467 |
| hCV7577344 | rs876445 | hCV16124825 | rs2109895 | 0.51 | 0.411716825 | 1 |
| hCV7577344 | rs876445 | hCV16175379 | rs2239657 | 0.51 | 0.411716825 | 0.9664 |
| hCV7577344 | rs876445 | hCV16234795 | rs2416804 | 0.51 | 0.411716825 | 0.6341 |
| hCV7577344 | rs876445 | hCV16234838 | rs2416819 | 0.51 | 0.411716825 | 0.4465 |
| hCV7577344 | rs876445 | hCV16234840 | rs2416817 | 0.51 | 0.411716825 | 0.4708 |
| hCV7577344 | rs876445 | hCV1632195 | rs1998505 | 0.51 | 0.411716825 | 0.4708 |
| hCV7577344 | rs876445 | hCV1761888 | rs1953126 | 0.51 | 0.411716825 | 0.9666 |
| hCV7577344 | rs876445 | hCV1761891 | rs1930778 | 0.51 | 0.411716825 | 0.9602 |
| hCV7577344 | rs876445 | hCV1761894 | rs1609810 | 0.51 | 0.411716825 | 0.9609 |
| hCV7577344 | rs876445 | hCV2359565 | rs1014530 | 0.51 | 0.411716825 | 0.6687 |
| hCV7577344 | rs876445 | hCV25613469 | rs10760157 | 0.51 | 0.411716825 | 0.4465 |
| hCV7577344 | rs876445 | hCV25751916 | rs10985070 | 0.51 | 0.411716825 | 0.6467 |
| hCV7577344 | rs876445 | hCV25771057 | rs10760150 | 0.51 | 0.411716825 | 0.4708 |
| hCV7577344 | rs876445 | hCV2783582 | rs10818482 | 0.51 | 0.411716825 | 0.6467 |
| hCV7577344 | rs876445 | hCV2783586 | rs2270231 | 0.51 | 0.411716825 | 0.9666 |
| hCV7577344 | rs876445 | hCV2783589 | rs881375 | 0.51 | 0.411716825 | 0.9666 |
| hCV7577344 | rs876445 | hCV2783590 | rs6478486 | 0.51 | 0.411716825 | 0.9666 |
| hCV7577344 | rs876445 | hCV2783591 | rs1468671 | 0.51 | 0.411716825 | 1 |
| hCV7577344 | rs876445 | hCV2783593 | rs1548783 | 0.51 | 0.411716825 | 1 |
| hCV7577344 | rs876445 | hCV2783597 | rs1860824 | 0.51 | 0.411716825 | 1 |
| hCV7577344 | rs876445 | hCV2783599 | rs7046108 | 0.51 | 0.411716825 | 1 |
| hCV7577344 | rs876445 | hCV2783604 | rs10760126 | 0.51 | 0.411716825 | 0.6875 |
| hCV7577344 | rs876445 | hCV2783607 | rs9886724 | 0.51 | 0.411716825 | 0.6785 |
| hCV7577344 | rs876445 | hCV2783608 | rs4836834 | 0.51 | 0.411716825 | 0.6687 |
| hCV7577344 | rs876445 | hCV2783609 | rs2241003 | 0.51 | 0.411716825 | 0.9321 |

TABLE 4-continued

| Interrogated SNP | Interrogated rs | LD SNP | LD SNP rs | Power | Threshold r² | r² |
|---|---|---|---|---|---|---|
| hCV7577344 | rs876445 | hCV2783611 | rs10435843 | 0.51 | 0.411716825 | 1 |
| hCV7577344 | rs876445 | hCV2783618 | rs2239658 | 0.51 | 0.411716825 | 1 |
| hCV7577344 | rs876445 | hCV2783620 | rs7021880 | 0.51 | 0.411716825 | 0.9301 |
| hCV7577344 | rs876445 | hCV2783621 | rs2416805 | 0.51 | 0.411716825 | 1 |
| hCV7577344 | rs876445 | hCV2783622 | rs758959 | 0.51 | 0.411716825 | 1 |
| hCV7577344 | rs876445 | hCV2783625 | rs10118357 | 0.51 | 0.411716825 | 0.6645 |
| hCV7577344 | rs876445 | hCV2783630 | rs2269060 | 0.51 | 0.411716825 | 0.6687 |
| hCV7577344 | rs876445 | hCV2783633 | rs7021049 | 0.51 | 0.411716825 | 0.6687 |
| hCV7577344 | rs876445 | hCV2783634 | rs1014529 | 0.51 | 0.411716825 | 1 |
| hCV7577344 | rs876445 | hCV2783635 | rs1930780 | 0.51 | 0.411716825 | 1 |
| hCV7577344 | rs876445 | hCV2783638 | rs3761846 | 0.51 | 0.411716825 | 0.6687 |
| hCV7577344 | rs876445 | hCV2783640 | rs3761847 | 0.51 | 0.411716825 | 0.6341 |
| hCV7577344 | rs876445 | hCV2783641 | rs2416806 | 0.51 | 0.411716825 | 1 |
| hCV7577344 | rs876445 | hCV2783647 | rs10739580 | 0.51 | 0.411716825 | 1 |
| hCV7577344 | rs876445 | hCV2783650 | rs10760129 | 0.51 | 0.411716825 | 0.6687 |
| hCV7577344 | rs876445 | hCV2783653 | rs10760130 | 0.51 | 0.411716825 | 0.6687 |
| hCV7577344 | rs876445 | hCV2783655 | rs10818488 | 0.51 | 0.411716825 | 0.6687 |
| hCV7577344 | rs876445 | hCV2783656 | rs4837804 | 0.51 | 0.411716825 | 0.8956 |
| hCV7577344 | rs876445 | hCV2783659 | rs7039505 | 0.51 | 0.411716825 | 1 |
| hCV7577344 | rs876445 | hCV27912350 | rs4837808 | 0.51 | 0.411716825 | 0.4708 |
| hCV7577344 | rs876445 | hCV27912351 | rs4837809 | 0.51 | 0.411716825 | 0.4708 |
| hCV7577344 | rs876445 | hCV29005923 | rs6478494 | 0.51 | 0.411716825 | 0.4238 |
| hCV7577344 | rs876445 | hCV29005924 | rs7031128 | 0.51 | 0.411716825 | 0.4264 |
| hCV7577344 | rs876445 | hCV29005976 | rs7037195 | 0.51 | 0.411716825 | 0.6687 |
| hCV7577344 | rs876445 | hCV29005978 | rs7021206 | 0.51 | 0.411716825 | 1 |
| hCV7577344 | rs876445 | hCV29006006 | rs7034390 | 0.51 | 0.411716825 | 0.9666 |
| hCV7577344 | rs876445 | hCV30059070 | rs10156413 | 0.51 | 0.411716825 | 0.5258 |
| hCV7577344 | rs876445 | hCV3045792 | rs6478499 | 0.51 | 0.411716825 | 0.4879 |
| hCV7577344 | rs876445 | hCV3045801 | rs2057465 | 0.51 | 0.411716825 | 0.4332 |
| hCV7577344 | rs876445 | hCV30563729 | rs9299273 | 0.51 | 0.411716825 | 0.4708 |
| hCV7577344 | rs876445 | hCV30830414 | rs7871371 | 0.51 | 0.411716825 | 0.417 |
| hCV7577344 | rs876445 | hCV30830468 | rs10818507 | 0.51 | 0.411716825 | 0.4539 |
| hCV7577344 | rs876445 | hCV30830473 | rs7036649 | 0.51 | 0.411716825 | 0.4705 |
| hCV7577344 | rs876445 | hCV30830475 | rs10733652 | 0.51 | 0.411716825 | 0.4269 |
| hCV7577344 | rs876445 | hCV30830484 | rs10818508 | 0.51 | 0.411716825 | 0.4708 |
| hCV7577344 | rs876445 | hCV30830486 | rs10760149 | 0.51 | 0.411716825 | 0.4708 |
| hCV7577344 | rs876445 | hCV30830503 | rs4837811 | 0.51 | 0.411716825 | 0.4708 |
| hCV7577344 | rs876445 | hCV30830512 | rs10818512 | 0.51 | 0.411716825 | 0.4465 |
| hCV7577344 | rs876445 | hCV30830521 | rs10818513 | 0.51 | 0.411716825 | 0.4465 |
| hCV7577344 | rs876445 | hCV30830536 | rs7047038 | 0.51 | 0.411716825 | 0.4465 |
| hCV7577344 | rs876445 | hCV30830638 | rs10985073 | 0.51 | 0.411716825 | 0.6467 |
| hCV7577344 | rs876445 | hCV30830725 | rs7864019 | 0.51 | 0.411716825 | 1 |
| hCV7577344 | rs876445 | hCV30830832 | rs10733648 | 0.51 | 0.411716825 | 1 |
| hCV7577344 | rs876445 | hCV30830909 | rs11794516 | 0.51 | 0.411716825 | 0.6467 |
| hCV7577344 | rs876445 | hCV7577250 | rs942153 | 0.51 | 0.411716825 | 0.4465 |
| hCV7577344 | rs876445 | hCV7577271 | rs1535655 | 0.51 | 0.411716825 | 0.4465 |
| hCV7577344 | rs876445 | hCV7577287 | rs1323478 | 0.51 | 0.411716825 | 0.4708 |
| hCV7577344 | rs876445 | hCV7577296 | rs1407910 | 0.51 | 0.411716825 | 0.4708 |
| hCV8780517 | rs1056567 | hCV1452630 | rs10818476 | 0.51 | 0.48547946 | 0.4886 |
| hCV8780517 | rs1056567 | hCV1452665 | rs4837796 | 0.51 | 0.48547946 | 0.4886 |
| hCV8780517 | rs1056567 | hCV1761881 | rs3933326 | 0.51 | 0.48547946 | 0.9646 |
| hCV8780517 | rs1056567 | hCV22272588 | rs10760117 | 0.51 | 0.48547946 | 0.4886 |
| hCV8780517 | rs1056567 | hCV25612709 | rs7026635 | 0.51 | 0.48547946 | 0.7608 |
| hCV8780517 | rs1056567 | hCV25757804 | rs4836833 | 0.51 | 0.48547946 | 1 |
| hCV8780517 | rs1056567 | hCV8780961 | rs914842 | 0.51 | 0.48547946 | 0.5969 |
| hCV8780517 | rs1056567 | hCV8780962 | rs1837 | 0.51 | 0.48547946 | 0.7943 |
| hCV8780962 | rs1837 | hCV1452630 | rs10818476 | 0.51 | 0.414165706 | 0.4622 |
| hCV8780962 | rs1837 | hCV1452651 | rs3793638 | 0.51 | 0.414165706 | 0.4281 |
| hCV8780962 | rs1837 | hCV1452652 | rs1060817 | 0.51 | 0.414165706 | 0.4281 |
| hCV8780962 | rs1837 | hCV1452665 | rs4837796 | 0.51 | 0.414165706 | 0.4622 |
| hCV8780962 | rs1837 | hCV1761881 | rs3933326 | 0.51 | 0.414165706 | 0.7653 |
| hCV8780962 | rs1837 | hCV22272588 | rs10760117 | 0.51 | 0.414165706 | 0.4622 |
| hCV8780962 | rs1837 | hCV25612709 | rs7026635 | 0.51 | 0.414165706 | 0.8902 |
| hCV8780962 | rs1837 | hCV25757804 | rs4836833 | 0.51 | 0.414165706 | 0.7943 |
| hCV8780962 | rs1837 | hCV26144018 | rs10739575 | 0.51 | 0.414165706 | 0.5329 |
| hCV8780962 | rs1837 | hCV2783659 | rs7039505 | 0.51 | 0.414165706 | 0.4242 |
| hCV8780962 | rs1837 | hCV30829523 | rs12343516 | 0.51 | 0.414165706 | 0.4281 |
| hCV8780962 | rs1837 | hCV8780517 | rs1056567 | 0.51 | 0.414165706 | 0.7943 |
| hCV8780962 | rs1837 | hCV8780961 | rs914842 | 0.51 | 0.414165706 | 0.6923 |

TABLE 5

Minor allele frequencies and allele-based association of chr 9q33 SNPs with RA
(SAMPLE SET 1 - 475 Cases/475 Controls)

| Marker | Gene | Type | Position & Alleles[a] | Case Genotypes | | | MAF[b] | HW[c] | Control Genotypes | | |
|---|---|---|---|---|---|---|---|---|---|---|---|
| | | | | 11 | 12 | 22 | | | 11 | 12 | 22 |
| rs10984984 | MEGF9 | intronic | T122503297C | 4 | 73 | 394 | 0.086 | 0.766 | 3 | 62 | 405 |
| rs10760112 | MEGF9 | intronic | C122507391T | 62 | 187 | 223 | 0.329 | 0.028 | 43 | 163 | 261 |
| rs10985014 | | | G122538111A | 13 | 117 | 341 | 0.152 | 0.472 | 12 | 93 | 364 |
| rs7026635 | FBXW2 | intronic | G122589848A | 40 | 185 | 247 | 0.281 | 0.568 | 31 | 154 | 285 |
| rs1577001 | LOC4023; | intronic | T122597128C | 0 | 15 | 457 | 0.016 | 1 | 0 | 18 | 452 |
| rs7873274 | LOC4023; | intronic | C122599313T | 7 | 79 | 384 | 0.099 | 0.198 | 7 | 76 | 387 |
| rs10985044 | | | A122603331G | 15 | 119 | 338 | 0.158 | 0.296 | 13 | 97 | 360 |
| rs10760117 | PSMD5 | intronic | T122626558G | 99 | 208 | 157 | 0.438 | 0.059 | 66 | 198 | 199 |
| rs10739575 | | | G122645922A | 18 | 122 | 332 | 0.167 | 0.135 | 13 | 107 | 348 |
| rs933003 | | | A122647650G | 0 | 21 | 451 | 0.022 | 1 | 1 | 10 | 458 |
| rs10985051 | | | C122647701A | 15 | 120 | 336 | 0.159 | 0.301 | 14 | 97 | 358 |
| rs13291973 | | | T122654694G | 5 | 64 | 403 | 0.078 | 0.192 | 4 | 55 | 410 |
| rs1837 | PHF19 | 3'UTR | T122658050C | 41 | 194 | 237 | 0.292 | 0.911 | 32 | 152 | 286 |
| rs1056567 | PHF19 | S181S | T122671866C | 55 | 205 | 212 | 0.334 | 0.606 | 38 | 182 | 250 |
| rs10985070 | PHF19 | intronic | C122675942A | 99 | 234 | 137 | 0.460 | 1 | 69 | 222 | 178 |
| rs1953126 | | | T122680321C | 61 | 221 | 184 | 0.368 | 0.765 | 45 | 197 | 223 |
| rs1930777 | | | A122680989G | 4 | 72 | 396 | 0.085 | 0.763 | 3 | 62 | 404 |
| rs1609810 | | | G122682172A | 61 | 222 | 184 | 0.368 | 0.691 | 43 | 194 | 224 |
| rs10985073 | | | T122683676C | 101 | 230 | 140 | 0.459 | 0.711 | 70 | 220 | 178 |
| rs7034390 | | | A122686309T | 62 | 227 | 183 | 0.372 | 0.555 | 45 | 198 | 227 |
| rs10818482 | | | A122687906G | 96 | 235 | 139 | 0.454 | 0.926 | 66 | 220 | 181 |
| rs2270231 | | | C122690803G | 62 | 227 | 182 | 0.373 | 0.555 | 47 | 197 | 226 |
| rs2072438 | | | T122691122C | 101 | 233 | 138 | 0.461 | 0.926 | 69 | 223 | 176 |
| rs881375 | | | T122692719C | 62 | 228 | 182 | 0.373 | 0.555 | 47 | 198 | 223 |
| rs6478486 | | | T122695150C | 63 | 226 | 182 | 0.374 | 0.623 | 45 | 197 | 227 |
| rs1860824 | | | G122699160T | 62 | 226 | 184 | 0.371 | 0.622 | 45 | 197 | 228 |
| rs10760126 | | | T122702439C | 101 | 230 | 140 | 0.459 | 0.711 | 68 | 222 | 180 |
| rs4836834 | TRAF1 | 3'UTR | T122705722A | 101 | 231 | 140 | 0.459 | 0.781 | 68 | 222 | 180 |
| rs10435844 | TRAF1 | intronic | G122708020T | 62 | 226 | 183 | 0.372 | 0.622 | 45 | 197 | 228 |
| rs2239657 | TRAF1 | P340P | G122711341A | 62 | 224 | 184 | 0.370 | 0.693 | 45 | 195 | 229 |
| rs12377786 | TRAF1 | intronic | G122711580T | 0 | 4 | 468 | 0.004 | 1 | 0 | 3 | 467 |
| rs2239658 | TRAF1 | intronic | T122711658C | 62 | 225 | 184 | 0.370 | 0.623 | 45 | 195 | 228 |
| rs7021880 | TRAF1 | intronic | C122713711G | 51 | 225 | 195 | 0.347 | 0.265 | 34 | 187 | 249 |
| rs3747841 | TRAF1 | S170S | A122715622G | 0 | 15 | 455 | 0.016 | 1 | 0 | 6 | 464 |
| rs2416804 | TRAF1 | intronic | G122716217C | 101 | 229 | 142 | 0.457 | 0.643 | 67 | 221 | 181 |
| rs2416805 | TRAF1 | intronic | T122716303C | 62 | 227 | 183 | 0.372 | 0.555 | 46 | 195 | 229 |
| rs876445 | TRAF1 | intronic | A122716923T | 62 | 226 | 183 | 0.372 | 0.622 | 45 | 197 | 228 |
| rs10118357 | TRAF1 | intronic | G122719889A | 103 | 228 | 140 | 0.461 | 0.579 | 68 | 222 | 180 |
| rs2269059 | TRAF1 | intronic | A122722293T | 3 | 74 | 395 | 0.085 | 1 | 4 | 61 | 405 |
| rs2191959 | TRAF1 | intronic | A122723655T | 3 | 74 | 395 | 0.085 | 1 | 3 | 62 | 405 |
| rs7021205 | TRAF1 | intronic | G122723803C | 103 | 229 | 140 | 0.461 | 0.643 | 68 | 222 | 180 |
| rs7021206 | TRAF1 | intronic | G122723978A | 62 | 223 | 184 | 0.370 | 0.693 | 45 | 194 | 228 |
| rs1014529 | TRAF1 | intronic | C122724764G | 62 | 226 | 183 | 0.372 | 0.622 | 45 | 197 | 228 |
| rs1930781 | TRAF1 | intronic | G122727655A | 63 | 225 | 183 | 0.373 | 0.694 | 45 | 197 | 227 |
| rs1930782 | TRAF1 | intronic | C122727726T | 97 | 234 | 140 | 0.454 | 1 | 66 | 219 | 183 |
| rs3761846 | | | C122729418T | 98 | 234 | 140 | 0.456 | 1 | 68 | 219 | 183 |
| rs2416806 | | | G122730113C | 62 | 224 | 185 | 0.369 | 0.693 | 45 | 196 | 228 |
| rs7864019 | | | A122732689T | 61 | 228 | 182 | 0.372 | 0.490 | 46 | 196 | 228 |
| rs10760130 | | | G122741811A | 98 | 230 | 141 | 0.454 | 0.852 | 68 | 223 | 177 |
| rs10818488 | | | A122744908G | 97 | 233 | 140 | 0.454 | 1 | 68 | 220 | 181 |
| rs2900180 | | | T122746203C | 59 | 222 | 185 | 0.365 | 0.617 | 45 | 194 | 223 |
| rs10760131 | | | G122749962T | 0 | 20 | 446 | 0.021 | 1 | 0 | 9 | 451 |
| rs12004487 | C5 | intronic | C122756502T | 5 | 74 | 386 | 0.090 | 0.407 | 3 | 67 | 398 |
| rs16910233 | C5 | intronic | G122763432C | 0 | 4 | 468 | 0.004 | 1 | 0 | 3 | 465 |
| rs2269066 | C5 | intronic | T122776839C | 5 | 86 | 381 | 0.102 | 1 | 1 | 67 | 401 |
| rs2269067 | C5 | intronic | C122776861G | 23 | 150 | 299 | 0.208 | 0.484 | 13 | 138 | 317 |
| rs2159776 | C5 | intronic | C122795981T | 98 | 242 | 131 | 0.465 | 0.517 | 87 | 221 | 160 |
| rs10760134 | C5 | intronic | C122798246T | 80 | 244 | 146 | 0.430 | 0.222 | 106 | 233 | 131 |
| rs7040033 | C5 | intronic | A122798865G | 83 | 243 | 146 | 0.433 | 0.348 | 107 | 232 | 131 |
| rs10760135 | C5 | intronic | T122802827C | 102 | 233 | 132 | 0.468 | 1 | 87 | 219 | 157 |
| rs17611 | C5 | I802V | A122809021G | 80 | 238 | 149 | 0.426 | 0.395 | 106 | 230 | 129 |
| rs10818496 | C5 | intronic | G122814284A | 71 | 225 | 176 | 0.389 | 1 | 69 | 205 | 196 |
| rs10985126 | C5 | G385G | C122823755T | 14 | 149 | 309 | 0.188 | 0.545 | 12 | 134 | 323 |
| rs993247 | C5 | intronic | G122825070A | 77 | 245 | 149 | 0.424 | 0.186 | 106 | 231 | 132 |
| rs2416811 | C5 | intronic | T122829455C | 76 | 247 | 146 | 0.425 | 0.108 | 108 | 230 | 132 |
| rs10156396 | C5 | intronic | T122830953C | 23 | 182 | 265 | 0.243 | 0.314 | 24 | 150 | 295 |
| rs10985132 | C5 | intronic | T122835515C | 23 | 183 | 266 | 0.243 | 0.261 | 24 | 150 | 295 |
| rs10818499 | C5 | intronic | A122839915T | 77 | 247 | 148 | 0.425 | 0.133 | 106 | 230 | 134 |
| rs9644911 | C5 | intronic | G122848925A | 23 | 185 | 264 | 0.245 | 0.214 | 24 | 150 | 295 |
| rs10739585 | C5 | intronic | G122849360C | 23 | 185 | 263 | 0.245 | 0.214 | 24 | 150 | 295 |
| rs7871371 | | | T122855883C | 23 | 183 | 265 | 0.243 | 0.261 | 25 | 149 | 295 |

TABLE 5-continued

Minor allele frequencies and allele-based association of chr 9q33 SNPs with RA
(SAMPLE SET 1 - 475 Cases/475 Controls)

| | | | | | | | | | | | |
|---|---|---|---|---|---|---|---|---|---|---|---|
| rs7855998 | | | T122855917C | 77 | 249 | 146 | 0.427 | 0.110 | 105 | 231 | 134 |
| rs7029523 | | | T122857434C | 22 | 183 | 264 | 0.242 | 0.208 | 24 | 150 | 295 |
| rs1924081 | | | A122862268T | 23 | 182 | 266 | 0.242 | 0.314 | 24 | 150 | 296 |
| rs1323472 | | | C122866156G | 79 | 247 | 146 | 0.429 | 0.159 | 72 | 211 | 186 |
| rs7042135 | | | T122876474C | 77 | 244 | 150 | 0.423 | 0.219 | 105 | 230 | 133 |
| rs6478498 | | | A122877723G | 78 | 247 | 147 | 0.427 | 0.158 | 105 | 231 | 134 |
| rs7856420 | | | G122878978C | 39 | 219 | 212 | 0.316 | 0.109 | 39 | 192 | 237 |
| rs10739586 | | | T122881893A | 40 | 217 | 215 | 0.315 | 0.166 | 39 | 189 | 242 |
| rs6478499 | | | A122882694G | 35 | 213 | 223 | 0.300 | 0.124 | 38 | 182 | 250 |
| rs4837808 | | | A122886441G | 35 | 214 | 222 | 0.301 | 0.101 | 38 | 182 | 250 |
| rs12685539 | CEP110 | intronic | G122896746T | 0 | 8 | 464 | 0.008 | 1 | 1 | 5 | 464 |
| rs10760146 | CEP110 | intronic | T122896906C | 73 | 248 | 151 | 0.417 | 0.089 | 105 | 228 | 137 |
| rs9299273 | CEP110 | intronic | T122898251A | 35 | 216 | 217 | 0.306 | 0.065 | 38 | 187 | 245 |
| rs9657673 | CEP110 | intronic | T122900196C | 72 | 247 | 152 | 0.415 | 0.089 | 106 | 227 | 137 |
| rs7022941 | CEP110 | intronic | G122907291C | 73 | 248 | 151 | 0.417 | 0.089 | 105 | 226 | 138 |
| rs1998506 | CEP110 | intronic | G122910284A | 40 | 219 | 213 | 0.317 | 0.137 | 39 | 193 | 238 |
| rs4837809 | CEP110 | intronic | T122913032G | 36 | 217 | 219 | 0.306 | 0.083 | 38 | 187 | 244 |
| rs1407910 | CEP110 | intronic | T122915251C | 36 | 216 | 219 | 0.306 | 0.103 | 38 | 185 | 246 |
| rs2146838 | CEP110 | intronic | G122916126A | 83 | 246 | 143 | 0.436 | 0.224 | 77 | 220 | 173 |
| rs1951784 | CEP110 | intronic | G122916272A | 74 | 246 | 152 | 0.417 | 0.131 | 104 | 229 | 136 |
| rs10818508 | CEP110 | intronic | G122922855A | 35 | 215 | 220 | 0.303 | 0.081 | 39 | 186 | 245 |
| rs10081760 | CEP110 | intronic | A122924127G | 40 | 219 | 212 | 0.317 | 0.136 | 37 | 194 | 239 |
| rs2900185 | CEP110 | intronic | A122927191G | 36 | 215 | 218 | 0.306 | 0.103 | 37 | 187 | 246 |
| rs4837811 | CEP110 | intronic | T122941415G | 36 | 216 | 219 | 0.306 | 0.103 | 38 | 187 | 244 |
| rs2068055 | CEP110 | intronic | T122943988A | 10 | 114 | 346 | 0.143 | 0.850 | 12 | 103 | 354 |
| rs10760151 | CEP110 | intronic | G122945183A | 78 | 244 | 150 | 0.424 | 0.221 | 108 | 228 | 133 |
| rs7036541 | CEP110 | intronic | G122945456C | 80 | 243 | 149 | 0.427 | 0.301 | 108 | 229 | 133 |
| rs12683062 | CEP110 | intronic | T122946625G | 6 | 100 | 366 | 0.119 | 1 | 7 | 93 | 369 |
| rs3747843 | CEP110 | intronic | A122954127G | 120 | 246 | 104 | 0.517 | 0.311 | 106 | 236 | 127 |
| rs3736855 | CEP110 | V1398V | A122956841T | 80 | 242 | 150 | 0.426 | 0.346 | 106 | 230 | 134 |
| rs10818512 | CEP110 | intronic | A122957176G | 37 | 214 | 221 | 0.305 | 0.158 | 38 | 183 | 249 |
| rs3736856 | CEP110 | intronic | G122960384A | 94 | 232 | 142 | 0.449 | 1 | 85 | 216 | 167 |
| rs2057466 | CEP110 | intronic | T122966751C | 40 | 219 | 211 | 0.318 | 0.136 | 39 | 193 | 238 |
| rs1535655 | CEP110 | intronic | G122968390A | 35 | 215 | 220 | 0.303 | 0.081 | 38 | 186 | 245 |
| rs2146836 | CEP110 | intronic | A122970117C | 40 | 218 | 212 | 0.317 | 0.137 | 37 | 193 | 240 |
| rs2302498 | CEP110 | intronic | A122976150T | 79 | 241 | 151 | 0.424 | 0.345 | 77 | 216 | 177 |
| rs7047038 | RAB14 | intronic | T122986768G | 35 | 215 | 221 | 0.303 | 0.082 | 38 | 182 | 242 |
| rs10760152 | RAB14 | intronic | A122987806C | 37 | 213 | 221 | 0.305 | 0.158 | 38 | 188 | 244 |
| rs10760153 | RAB14 | intronic | C122988196T | 79 | 243 | 148 | 0.427 | 0.258 | 107 | 229 | 131 |
| rs942152 | RAB14 | intronic | C122991506T | 89 | 242 | 140 | 0.446 | 0.403 | 87 | 221 | 161 |
| rs9408928 | RAB14 | intronic | C122991738T | 2 | 49 | 421 | 0.056 | 0.651 | 5 | 36 | 429 |
| rs9409230 | | | T123007581A | 1 | 49 | 417 | 0.055 | 1 | 4 | 34 | 426 |
| rs7030849 | | | C123009655T | 82 | 246 | 144 | 0.434 | 0.223 | 78 | 216 | 174 |
| rs747846 | | | T123022431G | 51 | 183 | 238 | 0.302 | 0.081 | 50 | 176 | 243 |
| rs12343027 | | | T123027074C | 3 | 48 | 421 | 0.057 | 0.188 | 1 | 49 | 420 |
| rs4837817 | | | C123034984G | 11 | 106 | 354 | 0.136 | 0.331 | 13 | 110 | 347 |
| rs4595204 | | | T123056182A | 0 | 33 | 439 | 0.035 | 1 | 2 | 31 | 436 |
| rs10985196 | GSN | intronic | A123072865C | 20 | 176 | 275 | 0.229 | 0.242 | 18 | 145 | 306 |
| rs306781 | GSN | intronic | C123082765T | 0 | 9 | 463 | 0.010 | 1 | 1 | 21 | 448 |
| rs11787991 | GSN | intronic | T123086454G | 1 | 28 | 443 | 0.032 | 0.379 | 0 | 37 | 431 |
| rs7046030 | GSN | intronic | C123087058T | 19 | 165 | 283 | 0.217 | 0.496 | 17 | 135 | 312 |
| rs12683459 | GSN | intronic | A123088119G | 19 | 170 | 283 | 0.220 | 0.349 | 17 | 140 | 313 |
| rs11788156 | GSN | intronic | C123111661G | 0 | 39 | 433 | 0.041 | 1 | 2 | 33 | 435 |
| rs4837839 | GSN | intronic | T123111948C | 94 | 223 | 154 | 0.436 | 0.453 | 122 | 224 | 123 |
| rs306783 | GSN | intronic | T123112418C | 100 | 235 | 136 | 0.462 | 1 | 81 | 236 | 151 |
| rs306784 | GSN | intronic | T123112473C | 69 | 236 | 165 | 0.398 | 0.336 | 58 | 219 | 191 |
| rs10818527 | GSN | intronic | A123115075G | 60 | 225 | 186 | 0.366 | 0.553 | 42 | 205 | 222 |
| rs16910509 | GSN | intronic | T123123292C | 13 | 98 | 361 | 0.131 | 0.066 | 16 | 79 | 375 |
| rs2304393 | GSN | G471G | T123123435C | 1 | 39 | 427 | 0.044 | 0.601 | 1 | 42 | 421 |
| rs12683989 | GSN | intronic | T123125867C | 1 | 50 | 421 | 0.055 | 1 | 0 | 47 | 423 |
| rs1560980 | GSN | intronic | C123133818G | 1 | 31 | 439 | 0.035 | 0.440 | 1 | 31 | 435 |
| rs7039494 | GSN | intronic | T123134411A | 12 | 136 | 324 | 0.169 | 0.744 | 18 | 108 | 341 |
| rs12340264 | STOM | intronic | T123149742C | 6 | 72 | 394 | 0.089 | 0.246 | 6 | 77 | 386 |
| rs12554081 | STOM | intronic | A123165145C | 13 | 117 | 342 | 0.151 | 0.472 | 19 | 89 | 362 |
| rs17086 | STOM | intronic | G123165341A | 68 | 203 | 200 | 0.360 | 0.162 | 69 | 190 | 210 |
| rs10818531 | STOM | intronic | T123168845C | 1 | 39 | 432 | 0.043 | 0.597 | 1 | 42 | 425 |
| rs367395 | STOM | intronic | T123171333G | 9 | 106 | 357 | 0.131 | 0.688 | 13 | 82 | 375 |

| Marker | MAF | HW[c] | OR (95% CI) | P[d] | Genotypic P[e] |
|---|---|---|---|---|---|
| rs10984984 | 0.072 | 0.725 | 1.21 (0.86-1.69) | 0.2768 | 0.563 |
| rs10760112 | 0.267 | 0.024 | 1.35 (1.11-1.65) | 0.0047 | 0.018 |
| rs10985014 | 0.125 | 0.055 | 1.26 (0.97-1.63) | 0.0991 | 0.174 |
| rs7026635 | 0.230 | 0.117 | 1.31 (1.06-1.61) | 0.0135 | 0.036 |
| rs1577001 | 0.019 | 1 | 0.83 (0.41-1.65) | 0.5864 | 0.589 |

TABLE 5-continued

Minor allele frequencies and allele-based association of chr 9q33 SNPs with RA
(SAMPLE SET 1 - 475 Cases/475 Controls)

| | | | | | |
|---|---|---|---|---|---|
| rs7873274 | 0.096 | 0.175 | 1.04 (0.76-1.41) | 0.8203 | 0.966 |
| rs10985044 | 0.131 | 0.064 | 1.24 (0.96-1.61) | 0.1075 | 0.218 |
| rs10760117 | 0.356 | 0.156 | 1.40 (1.17-1.69) | 6.11E−04 | 0.003 |
| rs10739575 | 0.142 | 0.183 | 1.21 (0.94-1.56) | 0.1428 | 0.344 |
| rs933003 | 0.013 | 0.069 | 1.76 (0.86-3.59) | 0.1263 | 0.116 |
| rs10985051 | 0.133 | 0.028 | 1.23 (0.95-1.59) | 0.1245 | 0.208 |
| rs13291973 | 0.067 | 0.146 | 1.18 (0.83-1.67) | 0.3634 | 0.664 |
| rs1837 | 0.230 | 0.068 | 1.38 (1.13-1.70) | 0.0025 | 0.005 |
| rs1056567 | 0.274 | 0.563 | 1.32 (1.09-1.61) | 0.0059 | 0.022 |
| rs10985070 | 0.384 | 1 | 1.37 (1.14-1.64) | 9.07E−04 | 0.004 |
| rs1953126 | 0.309 | 0.913 | 1.30 (1.08-1.58) | 0.0067 | 0.023 |
| rs1930777 | 0.072 | 0.725 | 1.18 (0.85-1.66) | 0.3277 | 0.629 |
| rs1609810 | 0.304 | 0.912 | 1.34 (1.10-1.62) | 0.0031 | 0.012 |
| rs10985073 | 0.385 | 0.922 | 1.36 (1.13-1.63) | 0.0013 | 0.006 |
| rs7034390 | 0.306 | 0.829 | 1.34 (1.11-1.62) | 0.0026 | 0.009 |
| rs10818482 | 0.377 | 1 | 1.38 (1.14-1.65) | 6.79E−04 | 0.003 |
| rs2270231 | 0.310 | 0.667 | 1.32 (1.09-1.60) | 0.0039 | 0.012 |
| rs2072438 | 0.386 | 1 | 1.36 (1.13-1.64) | 0.0010 | 0.004 |
| rs881375 | 0.312 | 0.747 | 1.31 (1.08-1.59) | 0.0052 | 0.016 |
| rs6478486 | 0.306 | 0.828 | 1.35 (1.12-1.64) | 0.0019 | 0.007 |
| rs1860824 | 0.305 | 0.828 | 1.34 (1.11-1.62) | 0.0026 | 0.009 |
| rs10760126 | 0.381 | 1 | 1.38 (1.15-1.65) | 6.90E−04 | 0.003 |
| rs4836834 | 0.381 | 1 | 1.38 (1.15-1.66) | 6.72E−04 | 0.003 |
| rs10435844 | 0.305 | 0.828 | 1.35 (1.11-1.63) | 0.0024 | 0.008 |
| rs2239657 | 0.304 | 0.743 | 1.35 (1.11-1.63) | 0.0024 | 0.008 |
| rs12377786 | 0.003 | 1 | 1.33 (0.30-5.95) | 0.7085 | 0.718 |
| rs2239658 | 0.304 | 0.743 | 1.34 (1.11-1.63) | 0.0025 | 0.009 |
| rs7021880 | 0.271 | 1 | 1.43 (1.17-1.74) | 3.12E−04 | 0.001 |
| rs3747841 | 0.006 | 1 | 2.52 (0.98-6.53) | 0.0470 | 0.046 |
| rs2416804 | 0.378 | 1 | 1.38 (1.15-1.66) | 6.58E−04 | 0.003 |
| rs2416805 | 0.305 | 0.664 | 1.35 (1.11-1.63) | 0.0023 | 0.007 |
| rs876445 | 0.305 | 0.828 | 1.35 (1.11-1.63) | 0.0024 | 0.008 |
| rs10118357 | 0.381 | 1 | 1.39 (1.16-1.67) | 5.08E−04 | 0.002 |
| rs2269059 | 0.073 | 0.300 | 1.17 (0.84-1.63) | 0.3656 | 0.481 |
| rs2191959 | 0.072 | 0.725 | 1.19 (0.85-1.66) | 0.3176 | 0.568 |
| rs7021049 | 0.381 | 1 | 1.39 (1.16-1.67) | 4.95E−04 | 0.002 |
| rs7021206 | 0.304 | 0.664 | 1.34 (1.11-1.63) | 0.0026 | 0.009 |
| rs1014529 | 0.305 | 0.828 | 1.35 (1.11-1.63) | 0.0024 | 0.008 |
| rs1930781 | 0.306 | 0.828 | 1.35 (1.11-1.63) | 0.0023 | 0.008 |
| rs1930782 | 0.375 | 1 | 1.39 (1.15-1.67) | 5.03E−04 | 0.002 |
| rs3761846 | 0.378 | 0.845 | 1.38 (1.15-1.66) | 6.53E−04 | 0.003 |
| rs2416806 | 0.305 | 0.745 | 1.34 (1.10-1.62) | 0.0031 | 0.011 |
| rs7864019 | 0.306 | 0.665 | 1.34 (1.11-1.62) | 0.0028 | 0.008 |
| rs10760130 | 0.384 | 0.922 | 1.34 (1.11-1.61) | 0.0020 | 0.008 |
| rs10818488 | 0.380 | 0.922 | 1.36 (1.13-1.64) | 0.0011 | 0.005 |
| rs2900180 | 0.307 | 0.744 | 1.29 (1.07-1.57) | 0.0087 | 0.026 |
| rs10760131 | 0.010 | 1 | 2.22 (1.01-4.90) | 0.0414 | 0.041 |
| rs12004487 | 0.078 | 0.753 | 1.17 (0.85-1.63) | 0.3420 | 0.608 |
| rs16910233 | 0.003 | 1 | 1.32 (0.30-5.93) | 0.7127 | 0.722 |
| rs2269066 | 0.074 | 0.498 | 1.43 (1.03-1.97) | 0.0296 | 0.063 |
| rs2269067 | 0.175 | 0.751 | 1.23 (0.98-1.55) | 0.0756 | 0.150 |
| rs2159776 | 0.422 | 0.507 | 1.19 (0.99-1.43) | 0.0611 | 0.106 |
| rs10760134 | 0.473 | 0.926 | 0.84 (0.70-1.01) | 0.0544 | 0.095 |
| rs7040033 | 0.474 | 0.853 | 0.85 (0.71-1.02) | 0.0700 | 0.129 |
| rs10760135 | 0.424 | 0.506 | 1.19 (0.99-1.43) | 0.0614 | 0.152 |
| rs17611 | 0.475 | 0.853 | 0.82 (0.68-0.98) | 0.0318 | 0.074 |
| rs10818496 | 0.365 | 0.197 | 1.11 (0.92-1.33) | 0.2916 | 0.363 |
| rs10985126 | 0.168 | 0.744 | 1.14 (0.90-1.44) | 0.2731 | 0.539 |
| rs993247 | 0.472 | 0.782 | 0.82 (0.68-0.98) | 0.0316 | 0.049 |
| rs2416811 | 0.474 | 0.711 | 0.82 (0.68-0.98) | 0.0302 | 0.032 |
| rs10156396 | 0.211 | 0.405 | 1.20 (0.96-1.49) | 0.1021 | 0.096 |
| rs10985132 | 0.211 | 0.405 | 1.20 (0.96-1.49) | 0.1013 | 0.093 |
| rs10818499 | 0.470 | 0.711 | 0.83 (0.69-1.00) | 0.0448 | 0.052 |
| rs9644911 | 0.211 | 0.405 | 1.21 (0.98-1.50) | 0.0804 | 0.069 |
| rs10739585 | 0.211 | 0.405 | 1.21 (0.98-1.51) | 0.0761 | 0.064 |
| rs7871371 | 0.212 | 0.271 | 1.19 (0.96-1.48) | 0.1088 | 0.076 |
| rs7855998 | 0.469 | 0.781 | 0.84 (0.70-1.01) | 0.0612 | 0.064 |
| rs7029523 | 0.211 | 0.405 | 1.19 (0.96-1.48) | 0.1074 | 0.080 |
| rs1924081 | 0.211 | 0.405 | 1.20 (0.96-1.49) | 0.1023 | 0.096 |
| rs1323472 | 0.378 | 0.377 | 1.23 (1.03-1.48) | 0.0246 | 0.019 |
| rs7042135 | 0.470 | 0.781 | 0.82 (0.69-0.99) | 0.0360 | 0.057 |
| rs6478498 | 0.469 | 0.781 | 0.84 (0.70-1.01) | 0.0618 | 0.077 |
| rs7856420 | 0.288 | 1 | 1.14 (0.94-1.39) | 0.1860 | 0.207 |
| rs10739586 | 0.284 | 0.821 | 1.16 (0.95-1.41) | 0.1418 | 0.172 |
| rs6478499 | 0.274 | 0.563 | 1.14 (0.93-1.39) | 0.2078 | 0.130 |
| rs4837808 | 0.274 | 0.563 | 1.14 (0.93-1.39) | 0.1897 | 0.113 |

TABLE 5-continued

Minor allele frequencies and allele-based association of chr 9q33 SNPs with RA
(SAMPLE SET 1 - 475 Cases/475 Controls)

| | | | | | |
|---|---|---|---|---|---|
| rs12685539 | 0.007 | 0.022 | 1.14 (0.41-3.15) | 0.8127 | 0.441 |
| rs10760146 | 0.466 | 0.579 | 0.82 (0.68-0.99) | 0.0316 | 0.026 |
| rs9299273 | 0.280 | 0.819 | 1.13 (0.93-1.38) | 0.2112 | 0.143 |
| rs9657673 | 0.467 | 0.517 | 0.81 (0.67-0.97) | 0.0218 | 0.017 |
| rs7022941 | 0.465 | 0.516 | 0.82 (0.69-0.99) | 0.0361 | 0.025 |
| rs1998506 | 0.288 | 1 | 1.14 (0.94-1.39) | 0.1711 | 0.220 |
| rs4837809 | 0.280 | 0.819 | 1.13 (0.93-1.38) | 0.2114 | 0.165 |
| rs1407910 | 0.278 | 0.730 | 1.14 (0.94-1.39) | 0.1830 | 0.135 |
| rs2146838 | 0.398 | 0.631 | 1.17 (0.98-1.41) | 0.0868 | 0.105 |
| rs1951784 | 0.466 | 0.711 | 0.82 (0.68-0.99) | 0.0320 | 0.038 |
| rs10818508 | 0.281 | 0.649 | 1.11 (0.91-1.36) | 0.2790 | 0.162 |
| rs10081760 | 0.285 | 0.822 | 1.17 (0.96-1.42) | 0.1186 | 0.198 |
| rs2900185 | 0.278 | 0.908 | 1.15 (0.94-1.40) | 0.1694 | 0.162 |
| rs4837811 | 0.280 | 0.819 | 1.13 (0.93-1.38) | 0.2191 | 0.176 |
| rs2068055 | 0.135 | 0.170 | 1.06 (0.82-1.38) | 0.6592 | 0.664 |
| rs10760151 | 0.473 | 0.580 | 0.82 (0.68-0.98) | 0.0293 | 0.041 |
| rs7036541 | 0.473 | 0.644 | 0.83 (0.69-0.99) | 0.0413 | 0.064 |
| rs12683062 | 0.114 | 0.648 | 1.05 (0.79-1.39) | 0.7573 | 0.849 |
| rs3747843 | 0.478 | 0.926 | 1.17 (0.98-1.40) | 0.0834 | 0.186 |
| rs3736855 | 0.470 | 0.711 | 0.84 (0.70-1.00) | 0.0513 | 0.089 |
| rs10818512 | 0.276 | 0.566 | 1.15 (0.95-1.41) | 0.1529 | 0.130 |
| rs3736856 | 0.412 | 0.296 | 1.16 (0.97-1.39) | 0.1168 | 0.219 |
| rs2057466 | 0.288 | 1 | 1.15 (0.95-1.40) | 0.1522 | 0.195 |
| rs1535655 | 0.279 | 0.732 | 1.12 (0.92-1.37) | 0.2466 | 0.169 |
| rs2146836 | 0.284 | 0.910 | 1.17 (0.96-1.43) | 0.1115 | 0.186 |
| rs2302498 | 0.394 | 0.440 | 1.13 (0.94-1.36) | 0.1852 | 0.178 |
| rs7047038 | 0.279 | 0.645 | 1.12 (0.92-1.37) | 0.2598 | 0.156 |
| rs10760152 | 0.281 | 0.820 | 1.12 (0.92-1.37) | 0.2492 | 0.259 |
| rs10760153 | 0.474 | 0.711 | 0.82 (0.69-0.99) | 0.0363 | 0.059 |
| rs942152 | 0.421 | 0.507 | 1.11 (0.92-1.33) | 0.2782 | 0.296 |
| rs9408928 | 0.049 | 0.003 | 1.16 (0.77-1.73) | 0.5026 | 0.195 |
| rs9409230 | 0.045 | 0.010 | 1.22 (0.80-1.85) | 0.3688 | 0.105 |
| rs7030849 | 0.397 | 0.441 | 1.16 (0.97-1.40) | 0.1027 | 0.088 |
| rs747846 | 0.294 | 0.045 | 1.04 (0.85-1.26) | 0.7274 | 0.910 |
| rs12343027 | 0.054 | 1 | 1.06 (0.71-1.57) | 0.7824 | 0.610 |
| rs4837817 | 0.145 | 0.261 | 0.93 (0.72-1.21) | 0.5914 | 0.858 |
| rs4595204 | 0.037 | 0.129 | 0.93 (0.58-1.52) | 0.7864 | 0.285 |
| rs10985196 | 0.193 | 0.882 | 1.24 (1.00-1.55) | 0.0506 | 0.094 |
| rs306781 | 0.024 | 0.241 | 0.38 (0.18-0.83) | 0.0142 | 0.074 |
| rs11787991 | 0.040 | 1 | 0.80 (0.49-1.30) | 0.3633 | 0.329 |
| rs7046030 | 0.182 | 0.640 | 1.25 (0.99-1.57) | 0.0563 | 0.106 |
| rs12683459 | 0.185 | 0.760 | 1.24 (0.99-1.56) | 0.0550 | 0.106 |
| rs11788156 | 0.039 | 0.155 | 1.05 (0.66-1.66) | 0.8301 | 0.234 |
| rs4837839 | 0.499 | 0.356 | 0.78 (0.65-0.93) | 0.0078 | 0.029 |
| rs306783 | 0.425 | 0.570 | 1.16 (0.97-1.39) | 0.1078 | 0.251 |
| rs306784 | 0.358 | 0.763 | 1.19 (0.98-1.43) | 0.0697 | 0.176 |
| rs10818527 | 0.308 | 0.665 | 1.30 (1.07-1.57) | 0.0070 | 0.026 |
| rs16910509 | 0.118 | 1.61E-04 | 1.13 (0.86-1.48) | 0.4142 | 0.274 |
| rs2304393 | 0.047 | 1 | 0.92 (0.60-1.43) | 0.7163 | 0.938 |
| rs12683989 | 0.050 | 0.620 | 1.11 (0.74-1.66) | 0.6148 | 0.554 |
| rs1560980 | 0.035 | 0.443 | 1.01 (0.62-1.65) | 0.9548 | 0.999 |
| rs7039494 | 0.154 | 0.020 | 1.12 (0.88-1.43) | 0.3775 | 0.091 |
| rs12340264 | 0.095 | 0.289 | 0.93 (0.68-1.27) | 0.6657 | 0.889 |
| rs12554081 | 0.135 | 2.00E-04 | 1.14 (0.88-1.48) | 0.3355 | 0.065 |
| rs17086 | 0.350 | 0.019 | 1.05 (0.87-1.26) | 0.6577 | 0.713 |
| rs10818531 | 0.047 | 1 | 0.92 (0.60-1.42) | 0.7092 | 0.935 |
| rs367395 | 0.115 | 0.005 | 1.16 (0.88-1.53) | 0.2945 | 0.123 |

[a]Positions according to genomic conting NT_008470.18 (Entrez Nucleotide). The minor allele is listed first, followed by the position in National Center for Biotechnology Information Genome Build 36.2 and then the major allele.
[b]MAF is the minor allele frequency.
[c]Hardy-Weinberg equilibrium testing was accomplished through the exact test of Weir as described in the Materials and Methods.
[d]Calculated using Cochran-Armitage Trend test.
[e]Calculated using William's-corrected G test.

TABLE 6

Minor allele frequencies and allele-based association of chr 9q33 SNPs with RA
(SAMPLE SET 2 - 661 Cases/1322 Controls)

| Marker | Gene | Type | Position & Alleles[a] | Case Genotypes | | | MAF[b] | HW[c] | Control Genotypes | | |
|---|---|---|---|---|---|---|---|---|---|---|---|
| | | | | 11 | 12 | 22 | | | 11 | 12 | 22 |
| rs10984984 | MEGF9 | intronic | T122503297C | | | | | | | | |
| rs10760112 | MEGF9 | intronic | C122507391T | 62 | 289 | 308 | 0.313 | 0.652 | 105 | 572 | 639 |
| rs10985014 | | | G122538111A | 10 | 160 | 489 | 0.137 | 0.513 | 22 | 325 | 969 |
| rs7026635 | FBXW2 | intronic | G122589848A | 46 | 272 | 341 | 0.276 | 0.437 | 67 | 505 | 745 |
| rs1577001 | LOC402377 | intronic | T122597128C | 1 | 29 | 629 | 0.024 | 0.303 | 0 | 54 | 1263 |
| rs7873274 | LOC402377 | intronic | C122599313T | 9 | 136 | 513 | 0.117 | 1 | 16 | 239 | 1058 |
| rs10985044 | | | A122603331G | | | | | | | | |
| rs10760117 | PSMD5 | intronic | T122626558G | 107 | 342 | 209 | 0.422 | 0.110 | 195 | 649 | 474 |
| rs10739575 | | | G122645922A | 14 | 202 | 443 | 0.175 | 0.135 | 25 | 349 | 942 |
| rs933003 | | | A122647650G | 0 | 32 | 627 | 0.024 | 1 | 0 | 56 | 1260 |
| rs10985051 | | | C122647701A | 15 | 167 | 477 | 0.149 | 0.879 | 24 | 347 | 946 |
| rs13291973 | | | T122654694G | 7 | 97 | 554 | 0.084 | 0.212 | 9 | 200 | 1107 |
| rs1837 | PHF19 | 3'UTR | T122658050C | 44 | 285 | 330 | 0.283 | 0.103 | 72 | 514 | 731 |
| rs1056567 | PHF19 | S181S | T122671866C | 65 | 320 | 274 | 0.341 | 0.046 | 104 | 571 | 641 |
| rs10985070 | PHF19 | intronic | C122675942A | | | | | | | | |
| rs1953126 | | | T122680321C | 87 | 319 | 250 | 0.376 | 0.405 | 125 | 561 | 632 |
| rs1930777 | | | A122680989G | | | | | | | | |
| rs1609810 | | | G122682172A | 87 | 325 | 245 | 0.380 | 0.215 | 125 | 558 | 633 |
| rs10985073 | | | T122683676C | | | | | | | | |
| rs7034390 | | | A122686309T | | | | | | | | |
| rs10818482 | | | A122687906G | | | | | | | | |
| rs2270231 | | | C122690803G | | | | | | | | |
| rs2072438 | | | T122691122C | | | | | | | | |
| rs881375 | | | T122692719C | 88 | 325 | 245 | 0.381 | 0.247 | 125 | 561 | 629 |
| rs6478486 | | | T122695150C | 87 | 325 | 246 | 0.379 | 0.246 | 124 | 558 | 631 |
| rs1860824 | | | G122699160T | | | | | | | | |
| rs10760126 | | | T122702439C | | | | | | | | |
| rs4836834 | TRAF1 | 3'UTR | T122705722A | 130 | 345 | 184 | 0.459 | 0.183 | 205 | 631 | 481 |
| rs10435844 | TRAF1 | intronic | G122708020T | | | | | | | | |
| rs2239657 | TRAF1 | P340P | G122711341A | 87 | 325 | 247 | 0.379 | 0.246 | 125 | 557 | 635 |
| rs12377786 | TRAF1 | intronic | G122711580T | | | | | | | | |
| rs2239658 | TRAF1 | intronic | T122711658C | | | | | | | | |
| rs7021880 | TRAF1 | intronic | C122713711G | 77 | 306 | 275 | 0.350 | 0.607 | 100 | 516 | 701 |
| rs3747841 | TRAF1 | S170S | A122715622G | 0 | 14 | 645 | 0.011 | 1 | 0 | 37 | 1279 |
| rs2416804 | TRAF1 | intronic | G122716217C | | | | | | | | |
| rs2416805 | TRAF1 | intronic | T122716303C | | | | | | | | |
| rs876445 | TRAF1 | intronic | A122716923T | | | | | | | | |
| rs10118357 | TRAF1 | intronic | G122719889A | | | | | | | | |
| rs2269059 | TRAF1 | intronic | A122722293T | 4 | 90 | 565 | 0.074 | 0.776 | 7 | 196 | 1114 |
| rs2191959 | TRAF1 | intronic | A122723655T | | | | | | | | |
| rs7021049 | TRAF1 | intronic | G122723803T | 133 | 342 | 184 | 0.461 | 0.273 | 204 | 630 | 483 |
| rs7021206 | TRAF1 | intronic | G122723978A | | | | | | | | |
| rs1014529 | TRAF1 | intronic | C122724764G | | | | | | | | |
| rs1930781 | TRAF1 | intronic | G122727655A | | | | | | | | |
| rs1930782 | TRAF1 | intronic | C122727726T | | | | | | | | |
| rs3761846 | | | C122729418T | | | | | | | | |
| rs2416806 | | | G122730113C | | | | | | | | |
| rs7864019 | | | A122732689T | | | | | | | | |
| rs10760130 | | | G122741811A | | | | | | | | |
| rs10818488 | | | A122744908G | | | | | | | | |
| rs2900180 | | | T122746203C | 88 | 325 | 244 | 0.381 | 0.247 | 126 | 558 | 633 |
| rs10760131 | | | G122749962T | 0 | 19 | 634 | 0.015 | 1 | 1 | 56 | 1242 |
| rs12004487 | C5 | intronic | C122756502T | 5 | 95 | 558 | 0.080 | 0.595 | 8 | 220 | 1089 |
| rs16910233 | C5 | intronic | G122763432C | 0 | 5 | 654 | 0.004 | 1 | 0 | 21 | 1295 |
| rs2269066 | C5 | intronic | T122776839C | 15 | 141 | 503 | 0.130 | 0.169 | 12 | 209 | 1096 |
| rs2269067 | C5 | intronic | C122776861G | 41 | 212 | 405 | 0.223 | 0.072 | 35 | 379 | 903 |
| rs2159776 | C5 | intronic | C122795981T | 134 | 333 | 191 | 0.457 | 0.638 | 261 | 642 | 414 |
| rs10760134 | C5 | intronic | C122798246T | | | | | | | | |
| rs7040033 | C5 | intronic | A122798865G | 128 | 339 | 192 | 0.451 | 0.346 | 308 | 640 | 368 |
| rs10760135 | C5 | intronic | T122802827C | 132 | 332 | 194 | 0.453 | 0.694 | 261 | 637 | 418 |
| rs17611 | C5 | I802V | A122809021G | 129 | 336 | 196 | 0.4493 | 0.530 | 305 | 646 | 371 |
| rs10818496 | C5 | intronic | G122814284A | 87 | 286 | 286 | 0.349 | 0.265 | 184 | 612 | 521 |
| rs10985126 | C5 | G385G | C122823755T | 34 | 198 | 425 | 0.202 | 0.091 | 27 | 362 | 928 |
| rs993247 | C5 | intronic | G122825070A | | | | | | | | |
| rs2416811 | C5 | intronic | T122829455C | 128 | 335 | 196 | 0.448 | 0.529 | 302 | 642 | 373 |
| rs10156396 | C5 | intronic | T122830953C | | | | | | | | |
| rs10985132 | C5 | intronic | T122835515C | | | | | | | | |
| rs10818499 | C5 | intronic | A122839915T | | | | | | | | |
| rs9644911 | C5 | intronic | G122848925A | 33 | 217 | 409 | 0.215 | 0.563 | 64 | 446 | 807 |
| rs10739585 | C5 | intronic | G122849360C | | | | | | | | |
| rs7871371 | | | T122855883C | | | | | | | | |

TABLE 6-continued

Minor allele frequencies and allele-based association of chr 9q33 SNPs with RA
(SAMPLE SET 2 - 661 Cases/1322 Controls)

| | | | | | | | | | | | |
|---|---|---|---|---|---|---|---|---|---|---|---|
| rs7855998 | | | T122855917C | | | | | | | | |
| rs7029523 | | | T122857434C | | | | | | | | |
| rs1924081 | | | A122862268T | | | | | | | | |
| rs1323472 | | | C122866156G | 110 | 326 | 222 | 0.415 | 0.630 | 190 | 606 | 521 |
| rs7042135 | | | T122876474C | | | | | | | | |
| rs6478498 | | | A122877723G | | | | | | | | |
| rs7856420 | | | G122878978C | | | | | | | | |
| rs10739586 | | | T122881893A | | | | | | | | |
| rs6478499 | | | A122882694G | | | | | | | | |
| rs4837808 | | | A122886441G | | | | | | | | |
| rs12685539 | CEP110 | intronic | G122896746T | 0 | 20 | 639 | 0.015 | 1 | 0 | 25 | 1291 |
| rs10760146 | CEP110 | intronic | T122896906C | | | | | | | | |
| rs9299273 | CEP110 | intronic | T122898251A | | | | | | | | |
| rs9657673 | CEP110 | intronic | T122900196C | 124 | 328 | 207 | 0.437 | 0.812 | 277 | 647 | 393 |
| rs7022941 | CEP110 | intronic | G122907291C | | | | | | | | |
| rs1998506 | CEP110 | intronic | G122910284A | | | | | | | | |
| rs4837809 | CEP110 | intronic | T122913032G | | | | | | | | |
| rs1407910 | CEP110 | intronic | T122915251C | | | | | | | | |
| rs2146838 | CEP110 | intronic | G122916126A | | | | | | | | |
| rs1951784 | CEP110 | intronic | G122916272A | | | | | | | | |
| rs10818508 | CEP110 | intronic | G122922855A | | | | | | | | |
| rs10081760 | CEP110 | intronic | A122924127G | 56 | 297 | 305 | 0.311 | 0.202 | 119 | 519 | 676 |
| rs2900185 | CEP110 | intronic | A122927191G | | | | | | | | |
| rs4837811 | CEP110 | intronic | T122941415G | | | | | | | | |
| rs2068055 | CEP110 | intronic | T122943988A | 15 | 146 | 498 | 0.134 | 0.310 | 24 | 356 | 934 |
| rs10760151 | CEP110 | intronic | G122945183A | | | | | | | | |
| rs7036541 | CEP110 | intronic | G122945456C | | | | | | | | |
| rs12683062 | CEP110 | intronic | T122946625G | 19 | 111 | 528 | 0.113 | 2.56E−04 | 11 | 236 | 1070 |
| rs3747843 | CEP110 | intronic | A122954127G | 164 | 337 | 158 | 0.505 | 0.586 | 321 | 640 | 355 |
| rs3736855 | CEP110 | V1398V | A122956841T | 129 | 325 | 205 | 0.442 | 1 | 256 | 611 | 370 |
| rs10818512 | CEP110 | intronic | A122957176G | | | | | | | | |
| rs3736856 | CEP110 | intronic | G122960384A | 128 | 318 | 213 | 0.436 | 0.635 | 236 | 638 | 443 |
| rs2057466 | CEP110 | intronic | T122966751C | | | | | | | | |
| rs1535655 | CEP110 | intronic | G122968390A | | | | | | | | |
| rs2146836 | CEP110 | intronic | A122970117C | | | | | | | | |
| rs2302498 | CEP110 | intronic | A122976150T | | | | | | | | |
| rs7047038 | RAB14 | intronic | T122986768G | | | | | | | | |
| rs10760152 | RAB14 | intronic | A122987806C | 55 | 293 | 311 | 0.306 | 0.271 | 110 | 506 | 701 |
| rs10760153 | RAB14 | intronic | C122988196T | | | | | | | | |
| rs942152 | RAB14 | intronic | C122991506T | 133 | 322 | 204 | 0.446 | 0.813 | 204 | 626 | 485 |
| rs9408928 | RAB14 | intronic | C122991738T | 5 | 70 | 583 | 0.061 | 0.084 | 7 | 112 | 1198 |
| rs9409230 | | | T123007581A | 3 | 65 | 589 | 0.054 | 0.427 | 8 | 101 | 1207 |
| rs7030849 | | | C123009655T | 117 | 326 | 215 | 0.426 | 0.750 | 186 | 588 | 462 |
| rs747846 | | | T123022431G | 70 | 259 | 330 | 0.303 | 0.080 | 180 | 575 | 562 |
| rs12343027 | | | T123027074C | 2 | 50 | 606 | 0.041 | 0.298 | 3 | 113 | 1201 |
| rs4837817 | | | C123034984G | 14 | 160 | 485 | 0.143 | 0.873 | 35 | 347 | 935 |
| rs4595204 | | | T123056182A | 1 | 58 | 599 | 0.046 | 1 | 0 | 120 | 1197 |
| rs10985196 | GSN | intronic | A123072865C | 46 | 217 | 396 | 0.234 | 0.039 | 35 | 363 | 919 |
| rs306781 | GSN | intronic | C123082765T | 0 | 31 | 628 | 0.024 | 1 | 0 | 65 | 1252 |
| rs11787991 | GSN | intronic | T123086454G | 2 | 41 | 616 | 0.034 | 0.171 | 1 | 76 | 1239 |
| rs7046030 | GSN | intronic | C123087058T | 40 | 209 | 408 | 0.220 | 0.068 | 34 | 342 | 942 |
| rs12683459 | GSN | intronic | A123088119G | 40 | 211 | 407 | 0.221 | 0.089 | 32 | 344 | 939 |
| rs11788156 | GSN | intronic | C123111661G | 2 | 57 | 600 | 0.046 | 0.644 | 2 | 100 | 1214 |
| rs4837839 | GSN | intronic | T123111948C | 136 | 303 | 220 | 0.436 | 0.096 | 263 | 641 | 412 |
| rs306783 | GSN | intronic | T123112418C | 142 | 294 | 223 | 0.439 | 0.018 | 249 | 612 | 455 |
| rs306784 | GSN | intronic | T123112473G | 104 | 292 | 262 | 0.380 | 0.137 | 178 | 595 | 544 |
| rs10818527 | GSN | intronic | A123115075G | 94 | 283 | 282 | 0.357 | 0.107 | 126 | 581 | 610 |
| rs16910509 | GSN | intronic | T123123292C | 14 | 128 | 516 | 0.119 | 0.090 | 25 | 350 | 942 |
| rs2304393 | GSN | G471G | T123123435C | 0 | 48 | 611 | 0.036 | 1 | 1 | 120 | 1195 |
| rs12683989 | GSN | intronic | T123125867C | 2 | 94 | 563 | 0.074 | 0.568 | 5 | 116 | 1196 |
| rs1560980 | GSN | intronic | C123133818G | 3 | 47 | 609 | 0.040 | 0.081 | 3 | 103 | 1210 |
| rs7039494 | GSN | intronic | T123134411A | 15 | 164 | 480 | 0.147 | 0.758 | 44 | 410 | 863 |
| rs12340264 | STOM | intronic | T123149742C | 8 | 108 | 543 | 0.094 | 0.355 | 17 | 235 | 1064 |
| rs12554081 | STOM | intronic | A123165145C | 18 | 150 | 491 | 0.141 | 0.145 | 34 | 381 | 902 |
| rs17086 | STOM | intronic | G123165341A | | | | | | | | |
| rs10818531 | STOM | intronic | T123168845C | 1 | 48 | 609 | 0.038 | 1 | 1 | 122 | 1194 |
| rs367395 | STOM | intronic | T123171333G | 11 | 131 | 517 | 0.116 | 0.445 | 25 | 340 | 949 |

| Marker | MAF | HW$^c$ | OR (95% CI) | P$^d$ | Genotypic P$^e$ |
|---|---|---|---|---|---|
| rs10984984 | | | | | |
| rs10760112 | 0.297 | 0.147 | 1.08 (0.94-1.25) | 0.2866 | 0.507 |
| rs10985014 | 0.140 | 0.424 | 0.97 (0.80-1.18) | 0.7527 | 0.944 |
| rs7026635 | 0.243 | 0.133 | 1.19 (1.03-1.38) | 0.0197 | 0.065 |
| rs1577001 | 0.021 | 1 | 1.15 (0.74-1.80) | 0.5377 | 0.412 |

TABLE 6-continued

Minor allele frequencies and allele-based association of chr 9q33 SNPs with RA
(SAMPLE SET 2 - 661 Cases/1322 Controls)

| | | | | | |
|---|---|---|---|---|---|
| rs7873274 | 0.103 | 0.550 | 1.15 (0.93-1.42) | 0.1894 | 0.404 |
| rs10985044 | | | | | |
| rs10760117 | 0.394 | 0.273 | 1.12 (0.98-1.29) | 0.0805 | 0.171 |
| rs10739575 | 0.152 | 0.285 | 1.18 (0.99-1.41) | 0.0580 | 0.141 |
| rs933003 | 0.021 | 1 | 1.14 (0.74-1.78) | 0.5419 | 0.546 |
| rs10985051 | 0.150 | 0.279 | 1.00 (0.83-1.20) | 0.9521 | 0.729 |
| rs13291973 | 0.083 | 1 | 1.02 (0.80-1.30) | 0.8704 | 0.672 |
| rs1837 | 0.250 | 0.142 | 1.19 (1.02-1.38) | 0.0216 | 0.067 |
| rs1056567 | 0.296 | 0.146 | 1.23 (1.07-1.42) | 0.0028 | 0.009 |
| rs10985070 | | | | | |
| rs1953126 | 0.308 | 1 | 1.35 (1.18-1.56) | 1.69E-05 | 7.83E-05 |
| rs1930777 | | | | | |
| rs1609810 | 0.307 | 0.897 | 1.38 (1.20-1.59) | 4.21E-06 | 1.55E-05 |
| rs10985073 | | | | | |
| rs7034390 | | | | | |
| rs10818482 | | | | | |
| rs2270231 | | | | | |
| rs2072438 | | | | | |
| rs881375 | 0.308 | 1 | 1.38 (1.20-1.58) | 4.78E-06 | 1.99E-05 |
| rs6478486 | 0.307 | 1 | 1.38 (1.20-1.58) | 4.83E-06 | 1.90E-05 |
| rs1860824 | | | | | |
| rs10760126 | | | | | |
| rs4836834 | 0.395 | 0.954 | 1.30 (1.14-1.48) | 1.10E-04 | 3.26E-04 |
| rs10435844 | | | | | |
| rs2239657 | 0.306 | 0.846 | 1.38 (1.20-1.58) | 4.86E-06 | 1.78E-05 |
| rs12377786 | | | | | |
| rs2239658 | | | | | |
| rs7021880 | 0.272 | 0.728 | 1.44 (1.25-1.66) | 5.09E-07 | 3.09E-06 |
| rs3747841 | 0.014 | 1 | 0.75 (0.41-1.40) | 0.3640 | 0.359 |
| rs2416804 | | | | | |
| rs2416805 | | | | | |
| rs876445 | | | | | |
| rs10118357 | | | | | |
| rs2269059 | 0.080 | 0.850 | 0.93 (0.72-1.19) | 0.5511 | 0.757 |
| rs2191959 | | | | | |
| rs7021049 | 0.394 | 1 | 1.32 (1.15-1.50) | 4.78E-05 | 1.79E-04 |
| rs7021206 | | | | | |
| rs1014529 | | | | | |
| rs1930781 | | | | | |
| rs1930782 | | | | | |
| rs3761846 | | | | | |
| rs2416806 | | | | | |
| rs7864019 | | | | | |
| rs10760130 | | | | | |
| rs10818488 | | | | | |
| rs2900180 | 0.308 | 0.846 | 1.39 (1.21-1.59) | 3.21E-06 | 1.19E-05 |
| rs10760131 | 0.022 | 0.478 | 0.65 (0.38-1.09) | 0.1003 | 0.286 |
| rs12004487 | 0.090 | 0.498 | 0.88 (0.69-1.12) | 0.2981 | 0.410 |
| rs16910233 | 0.008 | 1 | 0.47 (0.18-1.26) | 0.1238 | 0.111 |
| rs2269066 | 0.088 | 0.497 | 1.54 (1.25-1.89) | 7.19E-05 | 4.63E-04 |
| rs2269067 | 0.170 | 0.560 | 1.40 (1.19-1.65) | 7.10E-05 | 9.41E-05 |
| rs2159776 | 0.442 | 0.696 | 1.06 (0.93-1.21) | 0.3790 | 0.547 |
| rs10760134 | | | | | |
| rs7040033 | 0.477 | 0.377 | 0.90 (0.79-1.03) | 0.1269 | 0.127 |
| rs10760135 | 0.440 | 0.538 | 1.05 (0.92-1.20) | 0.4562 | 0.570 |
| rs17611 | 0.475 | 0.473 | 0.90 (0.79-1.03) | 0.1269 | 0.190 |
| rs10818496 | 0.372 | 0.860 | 0.90 (0.79-1.04) | 0.1597 | 0.263 |
| rs10985126 | 0.158 | 0.255 | 1.35 (1.14-1.60) | 5.15E-04 | 3.28E-04 |
| rs993247 | | | | | |
| rs2416811 | 0.473 | 0.439 | 0.91 (0.79-1.03) | 0.1444 | 0.200 |
| rs10156396 | | | | | |
| rs10985132 | | | | | |
| rs10818499 | | | | | |
| rs9644911 | 0.218 | 0.809 | 0.98 (0.84-1.15) | 0.8186 | 0.915 |
| rs10739585 | | | | | |
| rs7871371 | | | | | |
| rs7855998 | | | | | |
| rs7029523 | | | | | |
| rs1924081 | | | | | |
| rs1323472 | 0.374 | 0.518 | 1.19 (1.04-1.36) | 0.0140 | 0.036 |
| rs7042135 | | | | | |
| rs6478498 | | | | | |
| rs7856420 | | | | | |
| rs10739586 | | | | | |
| rs6478499 | | | | | |
| rs4837808 | | | | | |

TABLE 6-continued

Minor allele frequencies and allele-based association of chr 9q33 SNPs with RA
(SAMPLE SET 2 - 661 Cases/1322 Controls)

| SNP | | | | | |
|---|---|---|---|---|---|
| rs12685539 | 0.009 | 1 | 1.61 (0.89-2.90) | 0.1109 | 0.121 |
| rs10760146 | | | | | |
| rs9299273 | | | | | |
| rs9657673 | 0.456 | 0.739 | 0.93 (0.81-1.06) | 0.2600 | 0.480 |
| rs7022941 | | | | | |
| rs1998506 | | | | | |
| rs4837809 | | | | | |
| rs1407910 | | | | | |
| rs2146838 | | | | | |
| rs1951784 | | | | | |
| rs10818508 | | | | | |
| rs10081760 | 0.288 | 0.179 | 1.1 (0.96-1.29) | 0.1413 | 0.056 |
| rs2900185 | | | | | |
| rs4837811 | | | | | |
| rs2068055 | 0.154 | 0.167 | 0.85 (0.70-1.03) | 0.0887 | 0.052 |
| rs10760151 | | | | | |
| rs7036541 | | | | | |
| rs12683062 | 0.098 | 0.755 | 1.18 (0.95-1.46) | 0.1463 | 0.003 |
| rs3747843 | 0.487 | 0.348 | 1.07 (0.94-1.22) | 0.3029 | 0.343 |
| rs3736855 | 0.454 | 0.909 | 0.95 (0.83-1.09) | 0.4953 | 0.791 |
| rs10818512 | | | | | |
| rs3736856 | 0.421 | 0.821 | 1.06 (0.93-1.21) | 0.4007 | 0.682 |
| rs2057466 | | | | | |
| rs1535655 | | | | | |
| rs2146836 | | | | | |
| rs2302498 | | | | | |
| rs7047038 | | | | | |
| rs10760152 | 0.276 | 0.168 | 1.16 (1.00-1.34) | 0.0490 | 0.029 |
| rs10760153 | | | | | |
| rs942152 | 0.393 | 0.954 | 1.24 (1.09-1.42) | 0.0015 | 0.006 |
| rs9408928 | 0.048 | 0.026 | 1.29 (0.97-1.72) | 0.0949 | 0.261 |
| rs9409230 | 0.044 | 0.003 | 1.23 (0.91-1.66) | 0.1986 | 0.245 |
| rs7030849 | 0.388 | 1 | 1.17 (1.02-1.34) | 0.0259 | 0.082 |
| rs747846 | 0.355 | 0.092 | 0.79 (0.68-0.91) | 0.0014 | 0.005 |
| rs12343027 | 0.045 | 0.746 | 0.90 (0.65-1.26) | 0.5514 | 0.734 |
| rs4837817 | 0.158 | 0.679 | 0.88 (0.73-1.07) | 0.1993 | 0.437 |
| rs4595204 | 0.046 | 0.108 | 1.00 (0.73-1.37) | 0.9616 | 0.420 |
| rs10985196 | 0.164 | 1 | 1.56 (1.32-1.83) | 1.79E−07 | 4.93E−07 |
| rs306781 | 0.025 | 1 | 0.95 (0.62-1.47) | 0.8211 | 0.822 |
| rs11787991 | 0.030 | 1 | 1.16 (0.80-1.68) | 0.4460 | 0.494 |
| rs7046030 | 0.156 | 0.675 | 1.53 (1.29-1.81) | 9.85E−07 | 5.14E−06 |
| rs12683459 | 0.155 | 0.916 | 1.55 (1.31-1.83) | 4.86E−07 | 2.19E−06 |
| rs11788156 | 0.040 | 1 | 1.18 (0.85-1.63) | 0.3177 | 0.588 |
| rs4837839 | 0.443 | 0.655 | 0.97 (0.85-1.11) | 0.6753 | 0.505 |
| rs306783 | 0.422 | 0.090 | 1.07 (0.94-1.22) | 0.3286 | 0.383 |
| rs306784 | 0.361 | 0.473 | 1.08 (0.95-1.24) | 0.2536 | 0.390 |
| rs10818527 | 0.316 | 0.484 | 1.20 (1.05-1.38) | 0.0100 | 0.008 |
| rs16910509 | 0.152 | 0.285 | 0.75 (0.62-0.92) | 0.0045 | 0.002 |
| rs2304393 | 0.046 | 0.523 | 0.78 (0.55-1.09) | 0.1402 | 0.342 |
| rs12683989 | 0.048 | 0.218 | 1.60 (1.22-2.10) | 7.02E−04 | 0.002 |
| rs1560980 | 0.041 | 0.487 | 0.97 (0.69-1.36) | 0.8590 | 0.622 |
| rs7039494 | 0.189 | 0.653 | 0.74 (0.62-0.89) | 0.0011 | 0.004 |
| rs12340264 | 0.102 | 0.296 | 0.91 (0.73-1.14) | 0.4284 | 0.708 |
| rs12554081 | 0.170 | 0.437 | 0.80 (0.66-0.96) | 0.0181 | 0.013 |
| rs17086 | | | | | |
| rs10818531 | 0.047 | 0.360 | 0.80 (0.57-1.12) | 0.1849 | 0.345 |
| rs367395 | 0.148 | 0.445 | 0.75 (0.62-0.92) | 0.0053 | 0.010 |

[a]Positions according to genomic conting NT_008470.18 (Entrez Nucleotide). The minor allele is listed first, followed by the position in National Center for Biotechnology Information Genome Build 36.2 and then the major allele.
[b]MAF is the minor allele frequency.
[c]Hardy-Weinberg equilibrium testing was accomplished through the exact test of Weir as described in the Materials and Methods.
[d]Calculated using Cochran-Armitage Trend test.
[e]Calculated using William's-corrected G test.

TABLE 7

Minor allele frequencies and allele-based association of chr 9q33 SNPs with RA - SAMPLE SET 3
(596 Cases/705 Controls)

| Marker | Gene | Type | Position & Alleles[a] | Case Genotypes | | | MAF | HW[c] | Control Genotypes | | |
|---|---|---|---|---|---|---|---|---|---|---|---|
| | | | | 11 | 12 | 22 | | | 11 | 12 | 22 |
| rs10984984 | MEGF9 | intronic | T122503297C | | | | | | | | |
| rs10760112 | MEGF9 | intronic | C122507391T | 57 | 247 | 284 | 0.307 | 0.771 | 71 | 283 | 346 |
| rs10985014 | | | G122538111A | | | | | | | | |
| rs7026635 | FBXW2 | intronic | G122589848A | 54 | 233 | 301 | 0.290 | 0.368 | 45 | 268 | 387 |
| rs1577001 | LOC402377 | intronic | T122597128C | | | | | | | | |
| rs7873274 | LOC402377 | intronic | C122599313T | | | | | | | | |
| rs10985044 | | | A122603331G | | | | | | | | |
| rs10760117 | PSMD5 | intronic | T122626558G | 115 | 292 | 180 | 0.445 | 0.933 | 124 | 319 | 253 |
| rs10739575 | | | G122645922A | 21 | 170 | 399 | 0.180 | 0.577 | 23 | 189 | 488 |
| rs933003 | | | A122647650G | 0 | 33 | 558 | 0.028 | 1 | 0 | 49 | 651 |
| rs10985051 | | | C122647701A | | | | | | | | |
| rs13291973 | | | T122654694G | | | | | | | | |
| rs1837 | PHF19 | 3'UTR | T122658050C | 54 | 239 | 296 | 0.295 | 0.553 | 45 | 271 | 383 |
| rs1056567 | PHF19 | S181S | T122671866C | 74 | 271 | 245 | 0.355 | 1 | 74 | 300 | 326 |
| rs10985070 | PHF19 | intronic | C122675942A | | | | | | | | |
| rs1953126 | | | T122680321C | 83 | 287 | 221 | 0.383 | 0.543 | 82 | 322 | 293 |
| rs1930777 | | | A122680989G | | | | | | | | |
| rs1609810 | | | G122682172A | 84 | 281 | 223 | 0.382 | 0.794 | 82 | 320 | 297 |
| rs10985073 | | | T122683676C | | | | | | | | |
| rs7034390 | | | A122686309T | | | | | | | | |
| rs10818482 | | | A122687906G | | | | | | | | |
| rs2270231 | | | C122690803G | | | | | | | | |
| rs2072438 | | | T122691122C | | | | | | | | |
| rs881375 | | | T122692719C | 86 | 278 | 223 | 0.383 | 1 | 85 | 320 | 294 |
| rs6478486 | | | T122695150C | 85 | 276 | 224 | 0.381 | 1 | 81 | 320 | 297 |
| rs1860824 | | | G122699160T | | | | | | | | |
| rs10760126 | | | T122702439C | | | | | | | | |
| rs4836834 | TRAF1 | 3'UTR | T122705722A | 137 | 301 | 151 | 0.488 | 0.621 | 136 | 332 | 232 |
| rs10435844 | TRAF1 | intronic | G122708020T | | | | | | | | |
| rs2239657 | TRAF1 | P340P | G122711341A | 85 | 282 | 224 | 0.382 | 0.862 | 82 | 320 | 298 |
| rs12377786 | TRAF1 | intronic | G122711580T | | | | | | | | |
| rs2239658 | TRAF1 | intronic | T122711658C | | | | | | | | |
| rs7021880 | TRAF1 | intronic | C122713711G | 78 | 274 | 238 | 0.364 | 1 | 79 | 309 | 312 |
| rs3747841 | TRAF1 | S170S | A122715622G | | | | | | | | |
| rs2416804 | TRAF1 | intronic | G122716217C | | | | | | | | |
| rs2416805 | TRAF1 | intronic | T122716303C | | | | | | | | |
| rs876445 | TRAF1 | intronic | A122716923T | | | | | | | | |
| rs10118357 | TRAF1 | intronic | G122719889A | | | | | | | | |
| rs2269059 | TRAF1 | intronic | A122722293T | | | | | | | | |
| rs2191959 | TRAF1 | intronic | A122723655T | | | | | | | | |
| rs7021049 | TRAF1 | intronic | G122723803T | 138 | 299 | 154 | 0.486 | 0.805 | 137 | 331 | 232 |
| rs7021206 | TRAF1 | intronic | G122723978A | | | | | | | | |
| rs1014529 | TRAF1 | intronic | C122724764G | | | | | | | | |
| rs1930781 | TRAF1 | intronic | G122727655A | | | | | | | | |
| rs1930782 | TRAF1 | intronic | C122727726T | | | | | | | | |
| rs3761846 | | | C122729418T | | | | | | | | |
| rs2416806 | | | G122730113C | | | | | | | | |
| rs7864019 | | | A122732689T | | | | | | | | |
| rs10760130 | | | G122741811A | | | | | | | | |
| rs10818488 | | | A122744908G | | | | | | | | |
| rs2900180 | | | T122746203C | 88 | 283 | 219 | 0.389 | 0.863 | 85 | 323 | 292 |
| rs10760131 | | | G122749962T | | | | | | | | |
| rs12004487 | C5 | intronic | C122756502T | | | | | | | | |
| rs16910233 | C5 | intronic | G122763432C | | | | | | | | |
| rs2269066 | C5 | intronic | T122776839C | 10 | 115 | 465 | 0.114 | 0.314 | 7 | 141 | 552 |
| rs2269067 | C5 | intronic | C122776861G | 33 | 215 | 343 | 0.238 | 1 | 25 | 231 | 444 |
| rs2159776 | C5 | intronic | C122795981T | 134 | 285 | 170 | 0.469 | 0.508 | 133 | 375 | 192 |
| rs10760134 | C5 | intronic | C122798246T | | | | | | | | |
| rs7040033 | C5 | intronic | A122798865G | 101 | 284 | 205 | 0.412 | 0.865 | 139 | 350 | 209 |
| rs10760135 | C5 | intronic | T122802827C | | | | | | | | |
| rs17611 | C5 | I802V | A122809021G | 102 | 275 | 209 | 0.409 | 0.494 | 145 | 341 | 213 |
| rs10818496 | C5 | intronic | G122814284A | | | | | | | | |
| rs10985126 | C5 | G385G | C122823755T | 26 | 204 | 359 | 0.217 | 0.717 | 30 | 205 | 465 |
| rs993247 | C5 | intronic | G122825070A | | | | | | | | |
| rs2416811 | C5 | intronic | T122829455C | 101 | 279 | 210 | 0.408 | 0.610 | 138 | 351 | 211 |
| rs10156396 | C5 | intronic | T122830953C | | | | | | | | |
| rs10985132 | C5 | intronic | T122835515C | | | | | | | | |
| rs10818499 | C5 | intronic | A122839915T | | | | | | | | |
| rs9644911 | C5 | intronic | G122848925A | | | | | | | | |
| rs10739585 | C5 | intronic | G122849360C | | | | | | | | |
| rs7871371 | | | T122855883C | | | | | | | | |

TABLE 7-continued

Minor allele frequencies and allele-based association of chr 9q33 SNPs with RA - SAMPLE SET 3
(596 Cases/705 Controls)

| | | | | | | | | | | | |
|---|---|---|---|---|---|---|---|---|---|---|---|
| rs7855998 | | | T122855917C | | | | | | | | |
| rs7029523 | | | T122857434C | | | | | | | | |
| rs1924081 | | | A122862268T | | | | | | | | |
| rs1323472 | | | C122866156G | 122 | 292 | 176 | 0.454 | 1 | | 118 | 321 | 261 |
| rs7042135 | | | A122876474C | | | | | | | | |
| rs6478498 | | | A122877723G | | | | | | | | |
| rs7856420 | | | G122878978C | | | | | | | | |
| rs10739586 | | | T122881893A | | | | | | | | |
| rs6478499 | | | A122882694G | | | | | | | | |
| rs4837808 | | | A122886441G | | | | | | | | |
| rs12685539 | CEP110 | intronic | G122896746T | | | | | | | | |
| rs10760146 | CEP110 | intronic | T122896906C | | | | | | | | |
| rs9299273 | CEP110 | intronic | T122898251A | | | | | | | | |
| rs9657673 | CEP110 | intronic | T122900196C | 98 | 280 | 213 | 0.403 | 0.732 | 134 | 342 | 224 |
| rs7022941 | CEP110 | intronic | G122907291C | | | | | | | | |
| rs1998506 | CEP110 | intronic | G122910284A | | | | | | | | |
| rs4837809 | CEP110 | intronic | T122913032G | | | | | | | | |
| rs1407910 | CEP110 | intronic | T122915251C | | | | | | | | |
| rs2146838 | CEP110 | intronic | G122916126A | | | | | | | | |
| rs1951784 | CEP110 | intronic | G122916272A | | | | | | | | |
| rs10818508 | CEP110 | intronic | G122922855A | | | | | | | | |
| rs10081760 | CEP110 | intronic | A122924127G | 67 | 263 | 261 | 0.336 | 1 | 62 | 303 | 332 |
| rs2900185 | CEP110 | intronic | A122927191G | | | | | | | | |
| rs4837811 | CEP110 | intronic | T122941415G | | | | | | | | |
| rs2068055 | CEP110 | intronic | T122943988A | | | | | | | | |
| rs10760151 | CEP110 | intronic | G122945183A | | | | | | | | |
| rs7036541 | CEP110 | intronic | G122945456C | | | | | | | | |
| rs12683062 | CEP110 | intronic | T122946625G | 11 | 128 | 451 | 0.127 | 0.577 | 10 | 131 | 559 |
| rs3747843 | CEP110 | intronic | A122954127G | 170 | 281 | 139 | 0.526 | 0.283 | 180 | 342 | 178 |
| rs3736855 | CEP110 | V1398V | A122956841T | 102 | 276 | 212 | 0.407 | 0.444 | 140 | 340 | 220 |
| rs10818512 | CEP110 | intronic | A122957176G | | | | | | | | |
| rs3736856 | CEP110 | intronic | G122960384A | | | | | | | | |
| rs2057466 | CEP110 | intronic | T122966751C | | | | | | | | |
| rs1535655 | CEP110 | intronic | G122968390A | | | | | | | | |
| rs2146836 | CEP110 | intronic | A122970117C | | | | | | | | |
| rs2302498 | CEP110 | intronic | A122976150T | | | | | | | | |
| rs7047038 | RAB14 | intronic | T122986768G | | | | | | | | |
| rs10760152 | RAB14 | intronic | A122987806C | 63 | 259 | 269 | 0.326 | 1 | 51 | 307 | 342 |
| rs10760153 | RAB14 | intronic | C122988196T | | | | | | | | |
| rs942152 | RAB14 | intronic | C122991506T | 141 | 293 | 157 | 0.486 | 0.869 | 137 | 330 | 232 |
| rs9408928 | RAB14 | intronic | C122991738T | 0 | 68 | 522 | 0.058 | 0.248 | 0 | 84 | 616 |
| rs9409230 | | | T123007581A | 0 | 60 | 530 | 0.051 | 0.390 | 1 | 70 | 629 |
| rs7030849 | | | C123009655T | 129 | 287 | 173 | 0.463 | 0.620 | 130 | 321 | 249 |
| rs747846 | | | T123022431G | | | | | | | | |
| rs12343027 | | | T123027074C | | | | | | | | |
| rs4837817 | | | C123034984G | | | | | | | | |
| rs4595204 | | | T123056182A | | | | | | | | |
| rs10985196 | GSN | intronic | A123072865C | 35 | 205 | 351 | 0.233 | 0.490 | 32 | 239 | 429 |
| rs306781 | GSN | intronic | C123082765T | 0 | 14 | 577 | 0.012 | 1 | 1 | 11 | 688 |
| rs11787991 | GSN | intronic | T123086454G | | | | | | | | |
| rs7046030 | GSN | intronic | C123087058T | 32 | 195 | 363 | 0.219 | 0.400 | 25 | 227 | 445 |
| rs12683459 | GSN | intronic | A123088119G | 32 | 193 | 366 | 0.217 | 0.334 | 25 | 229 | 446 |
| rs11788156 | GSN | intronic | C123111661G | | | | | | | | |
| rs4837839 | GSN | intronic | T123111948C | 114 | 263 | 214 | 0.415 | 0.042 | 149 | 329 | 222 |
| rs306783 | GSN | intronic | T123112418C | 131 | 276 | 184 | 0.455 | 0.159 | 136 | 341 | 223 |
| rs306784 | GSN | intronic | T123112473G | 98 | 270 | 223 | 0.394 | 0.302 | 87 | 334 | 279 |
| rs10818527 | GSN | intronic | A123115075G | 83 | 267 | 241 | 0.366 | 0.535 | 81 | 320 | 299 |
| rs16910509 | GSN | intronic | T123123292C | | | | | | | | |
| rs2304393 | GSN | G471G | T123123435C | | | | | | | | |
| rs12683989 | GSN | intronic | T123125867C | 2 | 67 | 522 | 0.060 | 1 | 0 | 83 | 614 |
| rs1560980 | GSN | intronic | C123133818G | | | | | | | | |
| rs7039494 | GSN | intronic | T123134411A | | | | | | | | |
| rs12340264 | STOM | intronic | T123149742C | | | | | | | | |
| rs12554081 | STOM | intronic | A123165145C | | | | | | | | |
| rs17086 | STOM | intronic | G123165341A | | | | | | | | |
| rs10818531 | STOM | intronic | T123168845C | | | | | | | | |
| rs367395 | STOM | intronic | T123171333G | | | | | | | | |

| Marker | MAF[b] | HW[c] | OR (95% CI) | P[d] | Genotypic P[e] |
|---|---|---|---|---|---|
| rs10984984 | | | | | |
| rs10760112 | 0.304 | 0.246 | 1.02 (0.86-1.20) | 0.8532 | 0.843 |
| rs10985014 | | | | | |
| rs7026635 | 0.256 | 0.921 | 1.19 (1.00-1.41) | 0.0534 | 0.118 |
| rs1577001 | | | | | |

TABLE 7-continued

Minor allele frequencies and allele-based association of chr 9q33 SNPs with RA - SAMPLE SET 3
(596 Cases/705 Controls)

| SNP | | | | | |
|---|---|---|---|---|---|
| rs7873274 | | | | | |
| rs10985044 | | | | | |
| rs10760117 | 0.407 | 0.182 | 1.16 (1.00-1.36) | 0.0599 | 0.099 |
| rs10739575 | 0.168 | 0.347 | 1.09 (0.89-1.33) | 0.4365 | 0.724 |
| rs933003 | 0.035 | 1 | 0.79 (0.51-1.24) | 0.2986 | 0.298 |
| rs10985051 | | | | | |
| rs13291973 | | | | | |
| rs1837 | 0.258 | 0.843 | 1.20 (1.01-1.43) | 0.0402 | 0.101 |
| rs1056567 | 0.320 | 0.728 | 1.17 (0.99-1.38) | 0.0612 | 0.165 |
| rs10985070 | | | | | |
| rs1953126 | 0.349 | 0.677 | 1.16 (0.99-1.36) | 0.0661 | 0.183 |
| rs1930777 | | | | | |
| rs1609810 | 0.346 | 0.802 | 1.17 (0.99-1.37) | 0.0600 | 0.171 |
| rs10985073 | | | | | |
| rs7034390 | | | | | |
| rs10818482 | | | | | |
| rs2270231 | | | | | |
| rs2072438 | | | | | |
| rs881375 | 0.351 | 0.934 | 1.15 (0.98-1.35) | 0.0849 | 0.227 |
| rs6478486 | 0.345 | 0.738 | 1.17 (0.99-1.37) | 0.0585 | 0.162 |
| rs1860824 | | | | | |
| rs10760126 | | | | | |
| rs4836834 | 0.431 | 0.397 | 1.26 (1.08-1.47) | 0.0042 | 0.010 |
| rs10435844 | | | | | |
| rs2239657 | 0.346 | 0.803 | 1.17 (1.00-1.38) | 0.0523 | 0.153 |
| rs12377786 | | | | | |
| rs2239658 | | | | | |
| rs7021880 | 0.334 | 0.865 | 1.15 (0.97-1.35) | 0.1020 | 0.259 |
| rs3747841 | | | | | |
| rs2416804 | | | | | |
| rs2416805 | | | | | |
| rs876445 | | | | | |
| rs10118357 | | | | | |
| rs2269059 | | | | | |
| rs2191959 | | | | | |
| rs7021049 | 0.432 | 0.355 | 1.24 (1.07-1.45) | 0.0062 | 0.016 |
| rs7021206 | | | | | |
| rs1014529 | | | | | |
| rs1930781 | | | | | |
| rs1930782 | | | | | |
| rs3761846 | | | | | |
| rs2416806 | | | | | |
| rs7864019 | | | | | |
| rs10760130 | | | | | |
| rs10818488 | | | | | |
| rs2900180 | 0.352 | 0.804 | 1.17 (1.00-1.37) | 0.0523 | 0.153 |
| rs10760131 | | | | | |
| rs12004487 | | | | | |
| rs16910233 | | | | | |
| rs2269066 | 0.111 | 0.701 | 1.04 (0.81-1.33) | 0.7678 | 0.544 |
| rs2269067 | 0.201 | 0.555 | 1.24 (1.03-1.50) | 0.0222 | 0.066 |
| rs2159776 | 0.458 | 0.040 | 1.05 (0.90-1.22) | 0.5509 | 0.130 |
| rs10760134 | | | | | |
| rs7040033 | 0.450 | 0.760 | 0.86 (0.73-1.00) | 0.0521 | 0.143 |
| rs10760135 | | | | | |
| rs17611 | 0.451 | 0.703 | 0.84 (0.72-0.98) | 0.0316 | 0.096 |
| rs10818496 | | | | | |
| rs10985126 | 0.189 | 0.219 | 1.19 (0.98-1.44) | 0.0799 | 0.113 |
| rs993247 | | | | | |
| rs2416811 | 0.448 | 0.760 | 0.85 (0.73-0.99) | 0.0401 | 0.100 |
| rs10156396 | | | | | |
| rs10985132 | | | | | |
| rs10818499 | | | | | |
| rs9644911 | | | | | |
| rs10739585 | | | | | |
| rs7871371 | | | | | |
| rs7855998 | | | | | |
| rs7029523 | | | | | |
| rs1924081 | | | | | |
| rs1323472 | 0.398 | 0.269 | 1.26 (1.08-1.47) | 0.0044 | 0.013 |
| rs7042135 | | | | | |
| rs6478498 | | | | | |
| rs7856420 | | | | | |

TABLE 7-continued

Minor allele frequencies and allele-based association of chr 9q33 SNPs with RA - SAMPLE SET 3
(596 Cases/705 Controls)

| | | | | | |
|---|---|---|---|---|---|
| rs10739586 | | | | | |
| rs6478499 | | | | | |
| rs4837808 | | | | | |
| rs12685539 | | | | | |
| rs10760146 | | | | | |
| rs9299273 | | | | | |
| rs9657673 | 0.436 | 0.878 | 0.87 (0.75-1.02) | 0.0924 | 0.240 |
| rs7022941 | | | | | |
| rs1998506 | | | | | |
| rs4837809 | | | | | |
| rs1407910 | | | | | |
| rs2146838 | | | | | |
| rs1951784 | | | | | |
| rs10818508 | | | | | |
| rs10081760 | 0.306 | 0.593 | 1.15 (0.97-1.35) | 0.1072 | 0.246 |
| rs2900185 | | | | | |
| rs4837811 | | | | | |
| rs2068055 | | | | | |
| rs10760151 | | | | | |
| rs7036541 | | | | | |
| rs12683062 | 0.108 | 0.433 | 1.20 (0.95-1.53) | 0.1339 | 0.327 |
| rs3747843 | 0.501 | 0.546 | 1.10 (0.95-1.29) | 0.2160 | 0.431 |
| rs3736855 | 0.443 | 0.702 | 0.86 (0.74-1.01) | 0.0681 | 0.182 |
| rs10818512 | | | | | |
| rs3736856 | | | | | |
| rs2057466 | | | | | |
| rs1535655 | | | | | |
| rs2146836 | | | | | |
| rs2302498 | | | | | |
| rs7047038 | | | | | |
| rs10760152 | 0.292 | 0.121 | 1.17 (0.99-1.38) | 0.0681 | 0.088 |
| rs10760153 | | | | | |
| rs942152 | 0.432 | 0.317 | 1.25 (1.07-1.45) | 0.0064 | 0.021 |
| rs9408928 | 0.060 | 0.166 | 0.96 (0.69-1.33) | 0.7920 | 0.792 |
| rs9409230 | 0.051 | 1 | 0.99 (0.70-1.40) | 0.9379 | 0.612 |
| rs7030849 | 0.415 | 0.140 | 1.21 (1.04-1.42) | 0.0173 | 0.048 |
| rs747846 | | | | | |
| rs12343027 | | | | | |
| rs4837817 | | | | | |
| rs4595204 | | | | | |
| rs10985196 | 0.216 | 0.912 | 1.10 (0.91-1.32) | 0.3268 | 0.513 |
| rs306781 | 0.009 | 0.055 | 1.28 (0.60-2.73) | 0.5371 | 0.404 |
| rs11787991 | | | | | |
| rs7046030 | 0.199 | 0.634 | 1.13 (0.94-1.37) | 0.1970 | 0.258 |
| rs12683459 | 0.199 | 0.555 | 1.12 (0.92-1.35) | 0.2590 | 0.272 |
| rs11788156 | | | | | |
| rs4837839 | 0.448 | 0.194 | 0.88 (0.75-1.02) | 0.1082 | 0.226 |
| rs306783 | 0.438 | 0.818 | 1.07 (0.92-1.25) | 0.3858 | 0.477 |
| rs306784 | 0.363 | 0.415 | 1.14 (0.97-1.34) | 0.1018 | 0.106 |
| rs10818527 | 0.344 | 0.802 | 1.10 (0.94-1.29) | 0.2448 | 0.399 |
| rs16910509 | | | | | |
| rs2304393 | | | | | |
| rs12683989 | 0.060 | 0.163 | 1.01 (0.73-1.40) | 0.9442 | 0.241 |
| rs1560980 | | | | | |
| rs7039494 | | | | | |
| rs12340264 | | | | | |
| rs12554081 | | | | | |
| rs17086 | | | | | |
| rs10818531 | | | | | |
| rs367395 | | | | | |

[a]Positions according to genomic conting NT_008470.18 (Entrez Nucleotide). The minor allele is listed first, followed by the position in National Center for Biotechnology Information Genome Build 36.2 and then the major allele.
[b]MAF is the minor allele frequency.
[c]Hardy-Weinberg equilibrium testing was accomplished through the exact test of Weir as described in the Materials and Methods.
[d]Calculated using Cochran-Armitage Trend test.
[e]Calculated using William's-corrected G test.

TABLE 8

| | Demographic and clinical information | | |
|---|---|---|---|
| | Sample Set | | |
| Subphenotype | 1[a] | 2[b] | 3[c] |
| Genetic background | White (North American) | White (North American) | White (Dutch) |
| No. of cases | 475 | 661 | 596 |
| No. of controls | 475 | 1322 | 705 |
| Female:male | 314:161 | 536:125 | 362:196[d] |

TABLE 8-continued

| | Demographic and clinical information | | |
|---|---|---|---|
| | Sample Set | | |
| Subphenotype | 1[a] | 2[b] | 3[c] |
| Average age of onset (years) | 46.97 ± 11.83 | 38.61 ± 13.61 | 54.58[e] ± 13.38 |
| % RF-positive | 100% | 82% | 72%[f] |

[a] All 950 samples were genotyped for a single SNP, rs10818488, in the candidate gene study performed by Kurreeman et al [35].
[b] 475 patient samples were included in the initial whole genome association study performed by Plenge et al [34].
[c] 436 patients and 94 controls samples were included in the candidate gene study performed by Kurreeman et al [35].
[d] Information on gender was available for 558 patients.
[e] Information on age of onset was available for 306 patients.
[f] Information on RF status was available for 440 patients.

TABLE 9

Combined analysis of 43 chr 9q33.2 SNPs genotyped in all three RA sample sets

| | | | | Combined Analysis | | |
|---|---|---|---|---|---|---|
| Marker | Gene | Type | Position & Alleles[a] | $OR_{common}$ (95% CI)[b] | Trend $P_{comb}$[c] | Genotypic $P_{comb}$[c] |
| rs10760112 | MEGF9 | intronic | C122507391T | 1.17 (1.02-1.23) | 0.035 | 0.136 |
| rs7026635 | FBXW2 | intronic | G122589848A | 1.24 (1.10-1.35) | 0.001 | 0.012 |
| rs10760117 | PSMD5 | intronic | T122626558G | 1.26 (1.10-1.31) | 2.79E−04 | 0.003 |
| rs10739575 | | | G122645922A | 1.16 (1.03-1.30) | 0.081 | 0.349 |
| rs933003 | | | A122647650G | 1.12 (0.79-1.40) | 0.255 | 0.243 |
| rs1837 | PHF19 | 3'UTR | T122658050C | 1.28 (1.12-1.36) | 2.17E−04 | 0.002 |
| rs1056567 | PHF19 | S181S | T122671866C | 1.25 (1.12-1.35) | 1.11E−04 | 0.002 |
| rs1953126 | | | T122680321C | 1.28 (1.16-1.40) | 1.45E−06 | 4.24E−05 |
| rs1609810 | | | G122682172A | 1.29 (1.19-1.42) | 1.92E−07 | 5.24E−06 |
| rs881375 | | | T122692719C | 1.27 (1.17-1.41) | 4.69E−07 | 1.09E−05 |
| rs6478486 | | | T122695150C | 1.29 (1.19-1.42) | 1.35E−07 | 3.75E−06 |
| rs4836834 | TRAF1 | 3'UTR | T122705722A | 1.32 (1.19-1.43) | 8.13E−08 | 1.84E−06 |
| rs2239657 | TRAF1 | P340P | G122711341A | 1.29 (1.19-1.43) | 1.49E−07 | 3.89E−06 |
| rs7021880 | TRAF1 | intronic | C122713711G | 1.33 (1.21-1.46) | 5.41E−09 | 2.27E−07 |
| rs7021049 | TRAF1 | intronic | G122723803T | 1.32 (1.20-1.43) | 4.09E−08 | 1.22E−06 |
| rs2900180 | | | T122746203C | 1.27 (1.18-1.41) | 3.32E−07 | 7.62E−06 |
| rs2269066 | C5 | intronic | T122776839C | 1.29 (1.14-1.53) | 1.68E−04 | 0.001 |
| rs2269067 | C5 | intronic | C122776861G | 1.27 (1.17-1.46) | 1.71E−05 | 1.04E−04 |
| rs2159776 | C5 | intronic | C122795981T | 1.11 (0.99-1.19) | 0.190 | 0.135 |
| rs7040033 | C5 | intronic | A122798865G | 0.86 (0.80-0.96) | 0.018 | 0.060 |
| rs17611 | C5 | I802V | A122809021G | 0.84 (0.79-0.94) | 0.006 | 0.040 |
| rs10985126 | C5 | G385G | C122823755T | 1.20 (1.11-1.39) | 8.69E−04 | 0.001 |
| rs2416811 | C5 | intronic | T122829455C | 0.85 (0.79-0.95) | 0.008 | 0.023 |
| rs1323472 | | | C122866156G | 1.23 (1.12-1.34) | 1.57E−04 | 7.06E−04 |
| rs9657673 | CEP110 | intronic | T122900196C | 0.86 (0.81-0.96) | 0.019 | 0.052 |
| rs10081760 | CEP110 | intronic | A122924127G | 1.15 (1.03-1.25) | 0.049 | 0.066 |
| rs12683062 | CEP110 | intronic | T122946625G | 1.12 (1.00-1.33) | 0.209 | 0.029 |
| rs3747843 | CEP110 | intronic | A122954127G | 1.13 (1.01-1.21) | 0.108 | 0.304 |
| rs3736855 | CEP110 | V1398V | A122956841T | 0.87 (0.82-0.98) | 0.048 | 0.191 |
| rs10760152 | RAB14 | intronic | A122987806C | 1.15 (1.05-1.27) | 0.028 | 0.024 |
| rs942152 | RAB14 | intronic | C122991506T | 1.18 (1.11-1.32) | 2.53E−04 | 0.002 |
| rs9408928 | RAB14 | intronic | C122991738T | 1.11 (0.93-1.38) | 0.364 | 0.378 |
| rs9409230 | | | T123007581A | 1.14 (0.93-1.40) | 0.499 | 0.217 |
| rs7030849 | | | C123009655T | 1.18 (1.08-1.29) | 0.003 | 0.014 |
| rs10985196 | GSN | intronic | A123072865C | 1.25 (1.18-1.46) | 6.33E−07 | 4.12E−06 |
| rs306781 | GSN | intronic | C123082765T | 0.68 (0.59-1.16) | 0.119 | 0.284 |
| rs7046030 | GSN | intronic | C123087058T | 1.26 (1.18-1.47) | 2.05E−06 | 1.99E−05 |
| rs12683459 | GSN | intronic | A123088119G | 1.25 (1.18-1.47) | 1.36E−06 | 9.79E−06 |
| rs4837839 | GSN | intronic | T123111948C | 0.85 (0.82-0.97) | 0.021 | 0.076 |
| rs306783 | GSN | intronic | T123112418C | 1.11 (1.00-1.19) | 0.198 | 0.405 |
| rs306784 | GSN | intronic | T123112473G | 1.15 (1.03-1.24) | 0.049 | 0.131 |
| rs10818527 | GSN | intronic | A123115075G | 1.21 (1.08-1.31) | 0.001 | 0.004 |
| rs12683989 | GSN | intronic | T123125867C | 1.17 (1.05-1.50) | 0.016 | 0.010 |

[a] Positions according to genomic contig NT_008470.18 (Entrez Nucleotide). The minor allele is listed first, followed by the position in National Center for Biotechnology Information Genome Build 36.2 and then the major allele.
[b] Calculated for the minor allele using a Mantel-Haenszel common OR.
[c] Calculated using Fisher's combined test.

TABLE 10

Three-SNP haplotypes for LD Block 1

| | Sample Set 1 Global P = 6.00E-04[a] | | | | Sample Set 2 Global P = 3.77E-05[a] | | | |
|---|---|---|---|---|---|---|---|---|
| | No. (Frequency) in | | | | No. (Frequency) in | | | |
| Haplotype[c] | Case | Control | P | OR | Case | Control | P | OR |
| AGT | 507 (0.539) | 582 (0.619) | 5.08E-04 | 0.72 | 708 (0.537) | 1595 (0.605) | 4.01E-05 | 0.76 |
| GCG | 326 (0.347) | 253 (0.269) | 2.13E-04 | 1.44 | 457 (0.347) | 714 (0.271) | 8.71E-07 | 1.43 |
| AGG | 85 (0.090) | 71 (0.075) | 0.250 | 1.22 | 108 (0.082) | 232 (0.088) | 0.540 | 0.93 |
| GGG | 22 (0.023) | 32 (0.034) | 0.168 | 0.68 | 41 (0.031) | 92 (0.035) | 0.539 | 0.89 |
| Other | 0 | 2 (0.002) | | | 4 (0.003) | 3 (0.001) | | |

| | Sample Set 3 Global P = 0.033[a] | | | | Combined Global $P_{comb}$[b] = 1.81E-07 | | |
|---|---|---|---|---|---|---|---|
| | No. (Frequency) in | | | | | | $OR_{common}$ |
| Haplotype[c] | Case | Control | P | OR | $P_{comb}$[b] | | (95% CI)[d] |
| AGT | 604 (0.512) | 794 (0.567) | 0.005 | 0.8 | 3.08E-08 | | 0.76 (0.70-0.83) |
| GCG | 425 (0.360) | 465 (0.332) | 0.133 | 1.13 | 8.00E-09 | | 1.32 (1.21-1.45) |
| AGG | 122 (0.103) | 120 (0.086) | 0.127 | 1.22 | NC | | 1.09 (0.93-1.27) |
| GGG | 25 (0.021) | 20 (0.014) | 0.135 | 1.49 | NC | | 0.93 (0.70-1.21) |
| Other | 5 (0.004) | 1 (0.001) | | | | | |

[a]The Haplo.Stats package was used to test for association between haplotypes and disease status.
[b]Calculated for haplotypes with the same effect (risk or protection) in all three sample sets, with use of Fisher's combined test.
[c]These haplotypes consist of the following SNPs: rs2239657, rs7021880, and rs7021049, respectively.

TABLE 11

Diplotype Analysis for the TRAF1-region SNPs rs2239657, rs7021880 and rs7021049

| | Sample Set 1 Global[a] P = 0.0069 | | | | Sample Set 2 Global[a] P = 1.3E-04 | | | |
|---|---|---|---|---|---|---|---|---|
| | No. (Frequency) in | | | | No. (Frequency) in | | | |
| Diplotype[c] | Case | Control | p[d] | OR | Case | Control | p[d] | OR |
| AGT/AGT | 140 (0.297) | 180 (0.383) | 0.006 | 0.68 | 183 (0.278) | 482 (0.366) | 8.21E-05 | 0.67 |
| AGT/Other | 51 (0.108) | 64 (0.136) | 0.197 | 0.77 | 86 (0.131) | 204 (0.155) | 0.157 | 0.82 |
| AGT/GCG | 178 (0.377) | 158 (0.336) | 0.197 | 1.20 | 255 (0.387) | 426 (0.324) | 0.006 | 1.32 |
| GCG/GCG | 51 (0.108) | 34 (0.072) | 0.068 | 1.55 | 76 (0.115) | 100 (0.076) | 0.004 | 1.59 |
| GCG/Other | 46 (0.098) | 27 (0.057) | 0.028 | 1.77 | 50 (0.076) | 87 (0.066) | 0.452 | 1.16 |
| Other/Other | 6 (0.013) | 7 (0.015) | 0.789 | 0.85 | 9 (0.014) | 18 (0.014) | 1.000 | 1.00 |

| | Sample Set 3 Global[a] P = 0.058 | | | | Combined Analysis Global[b] $P_{comb}$ = 8.22E-06 | | |
|---|---|---|---|---|---|---|---|
| | No. (Frequency) in | | | | | | $OR_{common}$[f] |
| Diplotype[c] | Case | Control | p[d] | OR | $P_{comb}$[e] | | (95% CI) |
| AGT/AGT | 153 (0.259) | 232 (0.331) | 0.005 | 0.7 | 5.35E-07 | | 0.68 (0.59-0.78) |
| AGT/Other | 81 (0.137) | 73 (0.104) | 0.085 | 1.36 | NC | | 0.94 (0.78-1.13) |
| AGT/GCG | 218 (0.369) | 257 (0.367) | 0.954 | 1.01 | 0.035 | | 1.18 (1.04-1.34) |
| GCG/GCG | 77 (0.130) | 78 (0.111) | 0.304 | 1.19 | 0.005 | | 1.42 (1.16-1.75) |
| GCG/Other | 54 (0.091) | 52 (0.074) | 0.309 | 1.25 | 0.086 | | 1.32 (1.04-1.66) |
| Other/Other | 8 (0.014) | 8 (0.011) | 0.804 | 1.19 | NC | | 1.01 (0.56-1.72) |

[a]Calculated using a Williams-corrected G test.
[b]Calculated using Fisher's combined test.
[c]Allele 1 rs2239657-allele 1 rs7021880-allele 1 rs7021049/allele 2 rs2239657-allele 2 rs7021880-allele 2 rs7021049.
[d]P-values calculated using Fisher's exact test.
[e]Calculated for diplotypes with the same effect (risk or protection) in all three sample sets, with use of Fisher's combined test.
[f]Mantel-Haenszel common odds ratio with confidence intervals from Monte Carlo simulation.

TABLE 12

Genotype counts of rs2239657, rs7021880 and rs7021049 stratified by the presence of rheumatoid factor

| | rs2239657 | | | | | | rs7021880 | | | | | |
|---|---|---|---|---|---|---|---|---|---|---|---|---|
| | Genotypes | | | | | | Genotypes | | | | | |
| | GG | GA | AA | MAF | $P^a$ | $OR_{Allelic}$ | CC | CG | GG | MAF | $P^a$ | $OR_{Allelic}$ |
| Sample Set 1[b] | | | | | | | | | | | | |
| RF-positive cases | 62 | 224 | 184 | 0.370 | 0.008 | 1.35 (1.11-1.63) | 51 | 225 | 195 | 0.347 | 0.001 | 1.43 (1.17-1.74) |
| controls | 45 | 195 | 229 | 0.304 | | | 34 | 187 | 249 | 0.271 | | |
| Sample Set 2 | | | | | | | | | | | | |
| RF-positive cases | 68 | 268 | 206 | 0.373 | 5.60E-04 | 1.32 (1.14-1.55) | 62 | 250 | 229 | 0.346 | 2.39E-04 | 1.27 (1.08-1.49) |
| matched controls | 106 | 457 | 520 | 0.309 | | | 87 | 425 | 571 | 0.277 | | |
| RF-negative cases | 19 | 57 | 41 | 0.406 | 0.013 | 1.63 (1.18-2.27) | 15 | 56 | 46 | 0.368 | 0.005 | 1.74 (1.24-2.44) |
| matched controls | 19 | 100 | 115 | 0.295 | | | 13 | 91 | 130 | 0.250 | | |
| Breslow-Day[c] | | | | | 0.263 | | | | | | 0.222 | |
| Sample Set 3 | | | | | | | | | | | | |
| RF-positive cases | 47 | 156 | 111 | 0.398 | 0.07 | 1.25 (1.03-1.52) | 42 | 151 | 121 | 0.374 | 0.184 | 1.19 (0.98-1.45) |
| RF-negative cases | 13 | 63 | 46 | 0.364 | 0.483 | 1.09 (0.82-1.44) | 12 | 63 | 47 | 0.357 | 0.312 | 1.11 (0.83-1.47) |
| Controls | 82 | 320 | 298 | 0.346 | | | 79 | 309 | 312 | 0.334 | | |
| Monte Carlo[d] | | | | | 0.218 | | | | | | 0.645 | |
| Combined | | | | | | | | | | | | |
| RF-positive cases[e] | | | | | 4.02E-05 | | | | | | 7.10E-06 | |
| RF-negative cases[f] | | | | | 0.038 | | | | | | 0.013 | |

| | rs7021049 | | | | | |
|---|---|---|---|---|---|---|
| | Genotypes | | | | | |
| | GG | GT | TT | MAF | $P^a$ | $OR_{Allelic}$ |
| Sample Set 1[b] | | | | | | |
| RF-positive cases | 103 | 229 | 140 | 0.461 | 0.002 | 1.39 (1.16-1.67) |
| controls | 68 | 222 | 180 | 0.381 | | |
| Sample Set 2 | | | | | | |
| RF-positive cases | 107 | 283 | 152 | 0.458 | 8.77E-04 | 1.30 (1.12-1.50) |
| matched controls | 175 | 505 | 403 | 0.395 | | |
| RF-negative cases | 26 | 59 | 32 | 0.474 | 0.054 | 1.41 (1.02-1.93) |
| matched controls | 29 | 125 | 80 | 0.391 | | |
| Breslow-Day[c] | | | | | 0.656 | |

TABLE 12-continued

Genotype counts of rs2239657, rs7021880 and rs7021049 stratified by the presence of rheumatoid factor Sample Set 3

| | | | | | | |
|---|---|---|---|---|---|---|
| RF-positive cases | 73 | 164 | 77 | 0.494 | 0.019 | 1.28 (1.06-1.55) |
| RF-negative cases | 21 | 67 | 34 | 0.447 | 0.297 | 1.06 (0.81-1.39) |
| Controls | 137 | 331 | 232 | 0.432 | | |
| Monte Carlo[d] | | | | | 0.116 | |
| Combined | | | | | | |
| RF-positive cases[e] | | | | | 5.68E-06 | |
| RF-negative cases[f] | | | | | 0.082 | |

[a] Genotypic P-values were calculated except where indicated.
[b] All cases in this study were RF-positive.
[c] Differential effects between RF-positive and RF-negative association were determined for sample set 2 using a Breslow-Day test (cases and controls were individually matched).
[d] Differential effects between RF-positive and RF-negative association were determined for sample set 3 using a Monte Carlo simulation (cases and controls were not individually matched).
[e] Includes all three sample sets.
[f] Includes sample sets 2 and 3.

TABLE 13

Pairwise logistic regression analysis of the 27 chr9q33.2 SNPs

| Group[a] | Marker | $r^2$ with rs7021049[b] | P[c] | P adjusted for rs7021049 | P adjusted for rs7021049 & rs10985196 |
|---|---|---|---|---|---|
| 3 | rs10760112 | 0.157 | 0.357 | 0.285 | 0.770 |
| 4 | rs10760117 | 0.329 | 0.011 | 0.760 | 0.579 |
| 5 | rs10739575 | 0.086 | 0.055 | 0.580 | 0.893 |
| 6 | rs933003 | 0.011 | 0.757 | 0.420 | 0.448 |
| 7 | rs1837, rs7026635 | 0.151 | 0.002 | 0.169 | 0.126 |
| 8 | rs1056567 | 0.243 | 5.22E-04 | 0.200 | 0.208 |
| 1 | rs2239657, rs1953126, rs1609810, rs881375, rs6478486, rs2900180 | 0.685 | 2.52E-06 | 0.217 | 0.254 |
| 9 | rs7021880 | 0.607 | 1.39E-06 | 0.104 | 0.072 |
| 2 | rs7021049, rs4836834 | 1 | 1.24E-06 | — | — |
| 10 | rs2269066 | 0.114 | 0.002 | 0.115 | 0.094 |
| 11 | rs2269067 | 0.261 | 7.64E-06 | 0.023 | 0.175 |
| 12 | rs2159776 | 0.143 | 0.291 | 0.367 | 0.598 |
| 13 | rs17611, rs7040033, rs2416811, rs9657673, rs3736855 | 0.328 | 0.011 | 0.716 | 0.450 |
| 14 | rs10985126 | 0.206 | 1.86E-04 | 0.103 | 0.992 |
| 15 | rs1323472, rs7030849 | 0.585 | 1.99E-04 | 0.935 | 0.415 |
| 16 | rs12683062 | 0.113 | 0.042 | 0.696 | 0.327 |
| 17 | rs3747843 | 0.337 | 0.112 | 0.123 | 0.059 |
| 18 | rs10760152, rs10081760 | 0.297 | 0.007 | 0.933 | 0.790 |
| 19 | rs942152 | 0.434 | 2.92E-05 | 0.161 | 0.919 |
| 20 | rs9408928, rs9409230 | 0.063 | 0.270 | 0.955 | 0.307 |
| 21 | rs10985196, rs7046030, rs12683459 | 0.089 | 6.17E-06 | 0.001 | — |
| 22 | rs306781 | 0.015 | 0.905 | 0.661 | 0.147 |
| 23 | rs4837839 | 0.079 | 0.171 | 0.988 | 0.667 |
| 24 | rs306783 | 0 | 0.192 | 0.210 | 0.987 |
| 25 | rs306784 | 0.009 | 0.054 | 0.144 | 0.876 |
| 26 | rs10818527 | 0.02 | 0.007 | 0.044 | 0.368 |
| 27 | rs12683989 | 0.019 | 0.009 | 0.054 | 0.573 |

[a] SNPs were grouped together if their pairwise $r^2$ values were >0.90. The first SNP in each group was used for the analyses. With the exception of Groups 1 and 2, they are listed in the order of appearance on the chromosome (for groups of SNPs, the position of the first SNP was used).
[b] Pairwise LD between rs7021049 and each of the 27 other SNPs as measured by $r^2$ in the cases and controls of the combined analysis of all three sample sets.
[c] Univariate analysis using logistic regression.

TABLE 14

Global P-values for backwards and forwards models using logistic regression.[a]

| Building Sample | | | Tested Sample Sets | | | |
|---|---|---|---|---|---|---|
| Set | Model | SNPs[b] | 1 | 2 | 3 | Combined |
| 1 | Forward | rs10760117 | 0.0022 | 0.135 | 0.165 | 1.31E-22 |
| 2 | Forward | rs7021880, rs12683062, rs10985196, rs4837839, rs12683989 | 0.067 | 6.40E-10 | 0.419 | 7.38E-25 |
| 3 | Forward | rs2159776, rs1323472 | 0.051 | 0.084 | 0.0048 | 1.08E-22 |

TABLE 14-continued

Global P-values for backwards and forwards models using logistic regression.[a]

| Building Sample | | | Tested Sample Sets | | | |
|---|---|---|---|---|---|---|
| Set | Model | SNPs[b] | 1 | 2 | 3 | Combined |
| Combined | Forward | rs7021049, rs10985196 | 0.010 | 8.25E−08 | 0.089 | 1.15E−27 |
| 1 | Backward | rs10985126, rs2269066, rs10760152, rs306781, rs1323472, rs1837 | 1.25E−04 | 5.82E−04 | 0.077 | 7.89E−23 |
| 2 | Backward | Same Model as Sample Set 2-Forward | 0.067 | 6.40E−10 | 0.419 | 7.38E−25 |
| 3 | Backward | rs2159776, rs3747843, rs2269066, rs2269067, rs1323472 | 0.0963 | 0.0018 | 0.0037 | 4.33E−24 |
| Combined | Backward | rs10818527, rs3747843, rs7021880, rs2269067, rs1323472 | 0.023 | 1.43E−06 | 0.063 | 5.61E−28 |

[a]Calculated using the log likelihood ratio test.
[b]SNPs included in each model.

TABLE 15

RA risk estimates for 3 loci - HLA-SE, PTPN22 and TRAF1-assuming a disease prevalence of 1%, 10% and 30%.

| Loci | | | Disease Prevalence | | | | | | |
|---|---|---|---|---|---|---|---|---|---|
| | | | 1% | | | | 10% | | |
| HLA[a] | PTPN22[b] | TRAF1[c] | P(MLG)[d] | P(RA\|MLG)[e] | RR[f] | SRR[g] | P(MLG)[d] | P(RA\|MLG)[e] RR[f] | SRR[g] |
| 0SE | CC | AGT/AGT | 0.189 | 0.003 | 0.29 (0.21-0.38) | 1.00 | 0.176 | 0.031 | 0.31 (0.23-0.40) | 1.00 |
| 0SE | CC | Other | 0.269 | 0.004 | 0.41 (0.33-0.50) | 1.41 | 0.254 | 0.043 | 0.43 (0.35-0.52) | 1.39 |
| 0SE | TT + TC | AGT/AGT | 0.039 | 0.005 | 0.50 (0.27-0.85) | 1.73 | 0.037 | 0.053 | 0.53 (0.29-0.86) | 1.70 |
| 0SE | CC | GCG/GCG | 0.036 | 0.006 | 0.56 (0.30-0.94) | 1.92 | 0.034 | 0.058 | 0.58 (0.32-0.94) | 1.87 |
| 0SE | TT + TC | Other | 0.055 | 0.007 | 0.71 (0.46-1.05) | 2.44 | 0.054 | 0.073 | 0.73 (0.49-1.05) | 2.35 |
| 0SE | TT + TC | GCG/GCG | 0.007 | 0.010 | 0.96 (0.69-1.16) | 3.33 | 0.007 | 0.097 | 0.97 (0.71-1.14) | 3.12 |
| 1SE | CC | AGT/AGT | 0.114 | 0.009 | 0.90 (0.29-3.26) | 3.09 | 0.113 | 0.090 | 0.90 (0.31-2.70) | 2.92 |
| 1SE | CC | Other | 0.162 | 0.013 | 1.26 (1.05-1.53) | 4.35 | 0.166 | 0.123 | 1.23 (1.04-1.46) | 3.98 |
| 1SE | TT + TC | AGT/AGT | 0.024 | 0.015 | 1.55 (0.92-2.70) | 5.34 | 0.025 | 0.147 | 1.47 (0.94-2.34) | 4.76 |
| 1SE | CC | GCG/GCG | 0.022 | 0.017 | 1.71 (1.00-3.09) | 5.92 | 0.023 | 0.161 | 1.61 (1.00-2.60) | 5.20 |
| 1SE | TT + TC | Other | 0.034 | 0.022 | 2.17 (1.48-3.37) | 7.49 | 0.037 | 0.196 | 1.96 (1.41-2.77) | 6.33 |
| 1SE | TT + TC | GCG/GCG | 0.005 | 0.029 | 2.94 (1.11-13.91) | 10.15 | 0.005 | 0.250 | 2.50 (1.10-6.40) | 8.07 |
| 2SE | CC | AGT/AGT | 0.014 | 0.043 | 4.29 (2.62-8.45) | 14.82 | 0.019 | 0.330 | 3.30 (2.26-5.04) | 10.67 |
| 2SE | CC | Other | 0.021 | 0.060 | 5.95 (3.98-10.07) | 20.55 | 0.030 | 0.410 | 4.10 (3.12-5.49) | 13.26 |
| 2SE | TT + TC | AGT/AGT | 0.003 | 0.072 | 7.23 (2.75-100) | 24.95 | 0.005 | 0.462 | 4.62 (2.39-10) | 14.90 |
| 2SE | CC | GCG/GCG | 0.003 | 0.080 | 7.96 (2.94-100) | 27.48 | 0.005 | 0.488 | 4.88 (2.58-10) | 15.74 |
| 2SE | TT + TC | Other | 0.004 | 0.099 | 9.91 (4.62-34.44) | 34.20 | 0.008 | 0.547 | 5.47 (3.47-8.57) | 17.68 |
| 2SE | TT + TC | GCG/GCG | 0.0006 | 0.131 | 13.06 (NC)[h] | 45.10 | 0.001 | 0.623 | 6.23 (NC)[h] | 20.12 |

| Loci | | | Disease Prevalence 30% | | | |
|---|---|---|---|---|---|---|
| HLA[a] | PTPN22[b] | TRAF1[c] | P(MLG)[d] | P(RA\|MLG)[e] | RR[f] | SRR[g] |
| 0SE | CC | AGT/AGT | 0.149 | 0.110 | 0.37 (0.27-0.46) | 1.00 |
| 0SE | CC | Other | 0.222 | 0.148 | 0.49 (0.41-0.59) | 1.35 |
| 0SE | TT + TC | AGT/AGT | 0.033 | 0.176 | 0.59 (0.34-0.89) | 1.61 |
| 0SE | CC | GCG/GCG | 0.031 | 0.192 | 0.64 (0.38-0.97) | 1.75 |
| 0SE | TT + TC | Other | 0.051 | 0.232 | 0.77 (0.55-1.04) | 2.11 |
| 0SE | TT + TC | GCG/GCG | 0.007 | 0.292 | 0.97 (0.36-1.96) | 2.66 |
| 1SE | CC | AGT/AGT | 0.110 | 0.277 | 0.92 (0.76-1.11) | 2.53 |
| 1SE | CC | Other | 0.175 | 0.351 | 1.17 (1.03-1.32) | 3.20 |
| 1SE | TT + TC | AGT/AGT | 0.027 | 0.400 | 1.33 (0.95-1.80) | 3.65 |
| 1SE | CC | GCG/GCG | 0.026 | 0.425 | 1.42 (1.00-1.91) | 3.88 |
| 1SE | TT + TC | Other | 0.045 | 0.485 | 1.62 (1.30-1.99) | 4.42 |
| 1SE | TT + TC | GCG/GCG | 0.007 | 0.563 | 1.88 (1.07-2.93) | 5.13 |
| 2SE | CC | AGT/AGT | 0.028 | 0.656 | 2.19 (1.76-2.65) | 5.97 |
| 2SE | CC | Other | 0.051 | 0.729 | 2.43 (2.12-2.75) | 6.64 |
| 2SE | TT + TC | AGT/AGT | 0.009 | 0.768 | 2.56 (1.83-3.33) | 7.00 |
| 2SE | CC | GCG/GCG | 0.009 | 0.786 | 2.62 (1.91-3.33) | 7.16 |
| 2SE | TT + TC | Other | 0.016 | 0.824 | 2.75 (2.25-3.19) | 7.50 |
| 2SE | TT + TC | GCG/GCG | 0.003 | 0.864 | 2.88 (NC)[h] | 7.88 |

[a]The number of copies of the HLA-DRB1 shared epitope (SE). SE+ HLA-DRB1 alleles include: 0101, 0102, 0401, 0404, 0405, 0408 and 1001.
[b]The PTPN22 R620W genotype (CC indicates homozygosity for the protective R620 allele; TT + TC indicates carriage of the risk W620 allele).
[c]The TRAF1 diplotype (allele 1 rs2239657-allele 1 rs7021880-allele 1 rs7021049/allele 2 rs2239657-allele 2 rs7021880-allele 2 rs7021049).
[d]Probability of the indicated 3-locus genotype.
[e]Probability of RA given the indicated 3-locus genotype.
[f]Relative risk and 95% confidence intervals from Monte Carlo simulations using 10,000 replicates.
[g]Standardized relative risk estimates setting the lowest value in each group to one.
[h]95% CIs were not calculated due to small counts.

TABLE 16

HapMap SNPs in high LD ($r^2 > 0.85$) with rs7021049 and rs2239657.

a. rs7021049[a]

| SNP | $r^2$ with rs7021049 | Position[b] | Region |
|---|---|---|---|
| rs10985070 | 0.967 | 122675942 | PHF19 |
| rs10985073 | 0.967 | 122683676 | PHF19-TRAF1 intergenic |
| rs10818482 | 0.967 | 122687906 | PHF19-TRAF1 intergenic |
| rs2072438 | 0.967 | 122691122 | PHF19-TRAF1 intergenic |
| rs10760126 | 1 | 122702439 | PHF19-TRAF1 intergenic |
| rs4836834 | 1 | 122705722 | TRAF1 |
| rs2416804 | 0.967 | 122716217 | TRAF1 |
| rs10118357 | 1 | 122719889 | TRAF1 |
| rs2269060 | 1 | 122723390 | TRAF1 |
| rs7037195 | 1 | 122723821 | TRAF1 |
| rs1014530 | 1 | 122724913 | TRAF1 |
| rs3761846 | 1 | 122729418 | TRAF1-C5 intergenic |
| rs3761847 | 0.967 | 122730060 | TRAF1-C5 intergenic |
| rs10760129 | 1 | 122740004 | TRAF1-C5 intergenic |
| rs10760130 | 1 | 122741811 | TRAF1-C5 intergenic |
| rs10818488 | 1 | 122744908 | TRAF1-C5 intergenic | b. rs2239657

| SNP | $r^2$ with rs2239657 | Position[b] | Region |
|---|---|---|---|
| rs1953126 | 0.934 | 122680321 | 5' PHF19 |
| rs1930778 | 0.96 | 122681190 | PHF19-TRAF1 intergenic |
| rs1609810 | 0.961 | 122682172 | PHF19-TRAF1 intergenic |
| rs7034390 | 0.934 | 122686309 | PHF19-TRAF1 intergenic |
| rs10760121 | 0.934 | 122687736 | PHF19-TRAF1 intergenic |
| rs2270231 | 0.934 | 122690803 | PHF19-TRAF1 intergenic |
| rs881375 | 0.934 | 122692719 | PHF19-TRAF1 intergenic |
| rs6478486 | 0.934 | 122695150 | PHF19-TRAF1 intergenic |
| rs1468671 | 0.966 | 122697323 | PHF19-TRAF1 intergenic |
| rs1860824 | 0.965 | 122699160 | PHF19-TRAF1 intergenic |
| rs7046108 | 0.966 | 122700160 | PHF19-TRAF1 intergenic |
| rs10435843 | 0.966 | 122707854 | TRAF1 |
| rs10435844 | 0.966 | 122708020 | TRAF1 |
| rs2239658 | 0.966 | 122711658 | TRAF1 |
| rs7021880 | 0.894 | 122713711 | TRAF1 |
| rs2416805 | 0.966 | 122716303 | TRAF1 |
| rs758959 | 0.966 | 122716520 | TRAF1 |
| rs876445 | 0.966 | 122716923 | TRAF1 |
| rs2109895 | 0.966 | 122717648 | TRAF1 |
| rs7021206 | 0.965 | 122723978 | TRAF1 |
| rs1014529 | 0.966 | 122724764 | TRAF1 |
| rs1930780 | 0.966 | 122726040 | TRAF1 |
| rs1930781 | 0.966 | 122727655 | TRAF1 |
| rs2416806 | 0.966 | 122730113 | TRAF1-C5 intergenic |
| rs7864019 | 0.966 | 122732689 | TRAF1-C5 intergenic |
| rs10739580 | 0.966 | 122735103 | TRAF1-C5 intergenic |
| rs10733648 | 0.966 | 122740600 | TRAF1-C5 intergenic |
| rs4837804 | 0.863 | 122745125 | TRAF1-C5 intergenic |
| rs7039505 | 1 | 122745766 | TRAF1-C5 intergenic |
| rs2900180 | 0.962 | 122746203 | TRAF1-C5 intergenic |

[a]rs1930782 at position 122727726, which was genotyped in this study but not in the HapMap, is in strong LD with rs7021049 ($r^2 > 0.95$).
[b]Positions according to genomic contig NT_008470.18 (Entrez Nucleotide).

SEQUENCE LISTING (1004 sequences)

SEQ ID NO: 1 - DNA, 5480 bp, Homo sapiens
tatatccgtggtttcctgctacctccaaccatgggccttttgggaatactttgttttttaatcttcctggggaaaacctggggacaggagcaaacatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaacaatacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcagtaaaagttagagtttattcgttgaatgacgacttgaagccagccaaaagagaaactgtcttaactttcatagatcctgaaggatcagaagttgacatggtagaagaaattgatcatattggaattatctcttttcctgacttcaagattccgtctaatcctagatatggtatgtggacgatcaaggctaaatataaagaggacttttcaacaactggaaccgcatattttgaagttaaagaatatgtcttgccacatttttctgtctcaatcgagccagaatataatttcattggttacaagaactttaagaattttgaaattactataaaagcaagatatttttataataaagtagtcactgaggctgacgtttatatcacatttggaataagagaagacttaaaagatgatcaaaaagaaatgatgcaaacagcaatgcaaaacacaatgttgataaatggaattgctcaagtcacatttgattctgaaacagcagtcaaagaactgtcatactacagtttagaagatttaaacaacaagtacctttatattgctgtaacagtcatagagtctacaggtggattttctgaagaggcagaaatacctggcatcaaatatgtcctctctccctacaaactgaatttggttgctactcctcttttcctgaagcctgggattccatatcccatcaaggtgcaggttaaagattcgcttgaccagttggtaggaggagtcccagtaacactgaatgcacaaacaattgatgtaaaccaagagacatctgacttggatccaagcaaaagtgtaacacgtgttgatgatggagtagcttcctttgtgcttaatctcccatctggagtgacggtgctggagtttaatgtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttgattttatccaagggcaaaattatccactttggcacgagggagaaattttcagatgcatcttatcaaagtataaacattccagtaacacagaacatggttccttcatcccgacttctggtctattacatcgtcacaggagaacagacagcagaattagtgtctgattcagtctggttaaatattgaagaaaaatgtggcaaccagctccaggttcatctgtctcctgatgcagatgcatattctccaggccaaactgtgtctcttaatatggcaactggaatggattcctgggtggcattagcagcagtggacagtgctgtgtatggagtccaaagaggagccaaaaagcccttggaaagagtatttcaattcttagagaagagtgatctgggctgtggggcaggtggtggcctcaacaatgccaatgtgttccacctagctggacttaccttcctcactaatgcaaatgcagatgactcccaagaaaatgatgaaccttgtaaagaaattctcaggccaagaagaacgctgcaaaagaagatagaagaaatagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacacatgaagaccctgttaccagtaagcaagccagaaattcggagttattttccagaaagctggttgtgggaagttcatcttgttcccagaagaaaacagttgcagtttgccctacctgattctctaaccacctgggaaattcaaggcgttggcatttcaaacactggtatatgtgttgctgatactgtcaaggcaaaggtgttcaaagatgtcttcctggaaatgaatataccatattctgttgtacgaggagaacagatccaattgaaaggaactgtttacaactataggacttctgggatgcagttctgtgttaaaatgtctgctgtggagggaatctgcacttcggaaagcccagtcattgatcatcagggcacaaagtcctccaaatgtgtgcgccagaaagtagagggctcctccagtcacttggtgacattcactgtgcttcctctggaaattggccttcacaacatcaatttttcactggagacttggtttggaaaagaaatcttagtaaaaacattacgagtggtgccagaaggtgtcaaaagggaaagctattctggtgttactttggatcctaggggtatttatggtaccattagcagacgaaaggagttcccatacaggatacccttagatttggtccccaaaacagaaatcaaaaggattttgagtgtaaaaggactgcttgtaggtgagatcttgtctgcagttctaagtcaggaaggcatcaatatcctaacccacctccccaaagggagtgcagaggcggagctgatgagcgttgtcccagtattctatgtttttcactacctggaaacaggaaatcattggaacatttttcattctgacccattaattgaaaagcagaaactgaagaaaaaattaaaagaagggatgttgagcattatgtcctacagaaatgctgactactcttacagtgtgtggaagggtggaagtgctagcacttggttaacagcttttgctttaagagtacttggacaagtaaataaatacgtagagcagaaccaaaattcaatttgtaattctttattgtggctagttgagaattatcaattagataatggatctttcaaggaaaattcacagtatcaaccaataaaattacagggtaccttgcctgttgaagcccgagagaacagcttatatcttacagcctttactgtgattggaattagaaaggctttcgatatatgccccctggtgaaaatcgacacagctctaattaaagctgacaactttctgcttgaaaatacactgccagcccagagcacctttacattggccatttctgcgtatgctctttccctgggagataaaactcacccacagtttcgttcaattgtttcagctttgaagagagaagctttggttaaaggtaatccacccatttatcgtttttggaaagacaatcttcagcataaagacagctctgtacctaacactggtacggcacgtatggtagaaacaactgcctatgctttactcaccagtctgaacttgaaagatataaattatgttaacccagtcatcaaatggctatcagaagagcagaggtatggaggtggcttttattcaacccaggacacaatcaatgccattgagggcctgacggaatattcactcctggttaaacaactccgcttgagtatggacatcgatgtttcttacaagcataaaggtgccttacataattataaaatgacagacaagaatttccttgggaggccagtagaggtgcttctcaatgatgacctcattgtcagtacaggatttggcagtggcttggctacagtacatgtaacaactgtagttcacaaaaccagtacctctgaggaagtttgcagcttttatttgaaaatcgatactcaggatattgaagcatcccactacagaggctacggaaactctgattacaaacgcatagtagcatgtgccagctacaagcccagcagggaagaatcatcatctggatcctctcatgcggtgatggacatctccttgcctactggaatcagtgcaaatgaagaagacttaaaagcccttgtggaaggggtggatcaactattcactgattaccaaatcaaagatggacatgttattctgcaactgaattcgattccctccagtgatttcctttgtgtacgattccggatatttgaactctttgaagttgggtttctcagtcctgccactttcacagtgtacgaataccacagaccagataaacagtgtaccatgttttatagcacttccaatatcaaaattcagaaagtctgtgaaggagccgcgtgcaagtgtgtagaagctgattgtgggcaaatgcaggaagaattggatctgacaatctctgcagagacaagaaaacaaacagcatgtaaaccagagattgcatatgcttataaagttagcatcacatccatcactgtagaaaatgtttttgtcaagtacaaggcaacccttctggatatctacaaaactggggaagctgttgctgagaaagactctgagattaccttcattaaaaaggtaacctgtactaacgctgagctggtaaaaggaagacagtacttaattatgggtaaagaagccctccagataaaatacaatttcagtttcaggtacatctaccctttagattccttgacctggattgaatactggcctagagacacaacatgttcatcgtgtcaagcatttttagctaatttagatgaatttgccgaagatatctttttaaatggatgctaaaattcctgaagttcagctgcatacagtttgcacttatggactcctgttgttgaagttcgtttttttgttttcttctttttttaaacattcatagctggtcttatttgtaaagctcactttacttagaattagtggcacttgcttttattagagaatgatttcaaatgctgtaactttctgaaataacatggccttggagggcatgaagacagatactcctccaaggttattggacaccggaaacaataaattggaacacctcctcaaacctaccactcaggaatgtttgctggggccgaaagaacagtccattgaaagggagtattacaaaaacatggcctttgcttgaaagaaaataccaaggaacaggaaactgatcattaaagcctgagtttgctttcaaaaaaaaaaaaaaaaaa

SEQ ID NO: 2 - DNA, 7431 bp, Homo sapiens
gttttgatgaacacctggctttattcttgcaatgaagaaaggttctcaacaaaaaatattctccaaagcaaagataccatcatcatctcactctcctatcccatcatctatgtccaatatgagatctaggtcactttcacctttgattggatcagagactctaccttttcattctggaggacagtggtgtgagcaagttgagattgcagatgaaaacaatatgcttttggactatcaagaccataaaggagctgattcacatgcaggagttagatatattacagaggccctcattaaaaaacttactaaacaggataatttggctttgataaaatctctgaacctttcactttctaaagacggtggcaagaaatttaagtatattgagaatttggaaaaatgtgttaaacttgaagtactgaatctcagctataatctaatagggaagattgaaaagttggacaagctgttaaaattacgtgaactcaacttatcatataacaaaatcagcaaaattgaaggcatagaaaatatgtgtaatctgcaaaagcttaaccttgcaggaaatgaaattgagcatattccagtatggttagggaagaagttaaaatctttgcgagtcctcaatttgaaaggcaacaagatatcatcgctccaagatataagcaagttgaaaccgcttcaagatttgatttctctgatcctagttgaaaatccagttgtgacccttcctcattacctccagtttaccattttccacctccgttcattggaaagtttggaaggtcagccagtaaccactcaggatagacaggaggcttttgagagattcagtttagaagaggtagaaagactggaaagagacctagaaaaaaagatgatagaaactgaagagcttaagagcaaacaaacaaggttccttgaggaaattaaaaatcaagataaattgaataaatcattaaaagaggaggccatgttacagaaacagagctgtgaggaactcaagagtgacttaaacacaaaaaatgaattgctaaaacagaagaccatagaattaacacgagcatgtcagaagcaatatgagctggaacaggaattggccttttataaaattgatgctaaatttgagccactaaattattatccatcagagtatgctgaaattgataaagccccagatgaaagcccttacattggcaaatccagatacaagagaaatatgtttgccacagagagttatattattgacagtgctcaggcagtacagatcaagaagatggagccagatgaacaacttagaaatgatcacatgaacttgagaggccacacaccactggacacgcaactggaagacaaagaaaaaaaaataagtgcagcacaaactcgactatcagaactgcatgatgaaatagaaaaggcagaacaacaaattttgagagctactgaagaatttaaacaactggaagaagctatacaactaaaaaagatttcagaagcagggaaagaccttctttacaagcagttgagtggtagactacaacttgtaaataaattacgccaggaagctctggatctagaactgcagatggaaaagcaaaagcaggaaattgccggaaagcagaaggagattaaggacctgcaaatagccatagatagcctggattccaaagacccaaaacattcccatatgaaggctcaaaagagcggtaaagaacaacagcttgacattatgaacaagcagtaccaacaacttgaaagtcgtttggatgagatactttctagaattgctaaggaaacggaagagattaaggaccttgaagaacagcttactgaaggccagatagcagcaaatgaagccctgaagaaggatttagaaggtgttatcagtgggttgcaagaatacctggggaccattaaaggccaggcaactcaggcccagaatgagtgcaggaagctgcgggatgagaaagagacattgttgcagagattgacagaagtcgagcaggagagagaccagctggaaatagttgccatggatgcagaaaatatgaggaaggagcttgcagagctagaaagtgccctccaagagcagcatgaggtgaatgcatctttgcagcagacccagggagatctcagtgcctatgaagctgagctagaggctcggctaaacctaagggatgctgaagccaaccagctcaaggaagagttggaaaaagtaacaagacttacccagttagaacaatcagcccttcaagcagaacttgagaaggaaaggcaagccctcaagaatgcccttggaaaagcccagttctcagaagaaaaggagcaagagaacagtgagctccatgcaaaacttaaacacttgcaggatgacaataatctgttaaaacagcaacttaaagatttccagaatcaccttaaccatgtggttgatggtttggttcgtccagaagaagtggcagctcgtgtggatgagctaagaagaaaactgaaattaggaactggggaaatgaacatccatagtccttcagatgtcttagggaaaagtcttgctgatttacagaaacaattcagtgaaattcttgcacgctccaagtgggaaagagatgaagcacaagttagagagagaaaactccaagaagaaatggctctgcagcaagagaaactggcaactggacaagaagagttcaggcaggcctgtgagagagccctggaagcaagaatgaattttgataagaggcaacatgaagcaagaatccagcaaatggagaatgaaattcactatttgcaagaaaatctaaaaagtatggaggaaatccaaggccttacagatctccaacttcaggaagctgatgaagagaaggagagaattctggcccaactccgagagttagagaaaaagaagaaacttgaagatgccaaatctcaggagcaagtttttggtttagataaagaactgaagaaactaaagaaagccgtggccacctctgataagctagccacagctgagctcaccattgccaaagaccagctgaagtcccttcatggaactgttatgaaaattaaccaggagcgagcagaggagttgcaggaagcagagaggttcagcagaaaggcagcacaagcagccagagatctcacccgagcagaagctgagatcgaactcctgcagaatctcctcaggcagaagggggagcagtttcgacttgagatggagaaaacaggtgtaggtactggagcaaactcacaggtcctagaaattgagaaactgaatgagacaatggaacgacaaaggacagagattgcaaggctgcagaatgtactagacctcactggaagtgacaacaaaggaggctttgaaaatgttttagaagaaattgctgaacttcgacgtgaagtttcttatcagaatgattacataagcagcatggcagatcctttcaaaagacgaggctattggtactttatgccaccaccaccatcatcaaaagtttccagccatagttcccaggccaccaaggactctggtgttggccttaagtactcagcctcaactcctgttagaaaaccacgccctgggcagcaggatgggaaggaaggcagtcaacctccccctgcctcaggatactgggtttattctcccatcaggagtgggttacataaactgtttccaagtagagatgcagacagtggaggagatagtcaggaagagagtgagctggatgaccaagaagaacccccatttgtgcctcctcctggatacatgatgtatactgtgcttcctgatggttctcctgtaccccagggcatggccctgtatgcaccacctcctcccttgccaaacaatagccgacctctcacccctggcactgttgtttatggcccacctcctgctggggcccccatggtgtatgggcctccaccccccaacttctccatccccttcatccctatgggtgtgctgcattgcaacgtccctgaacaccataacttagagaatgaagtttctagattagaagacataatgcagcatttaaaatcaaagaagcgggaagaaaggtggatgagagcatccaagcggcagtcggagaaagaaatggaagaactgcatcataatattgatgatcttttgcaagagaagaaaagcttagagtgtgaagtagaagaattacatagaactgtccagaaacgtcaacagcaaaaggacttcattgatggaaatgttgagagtcttatgactgaactagaaatagaaaaatcactcaaacatcatgaagatattgtagatgaaattgagtgcattgagaagactcttctgaaacgtcgctcagagctcagggaagctgaccgactcctggcagaggctgagagtgaactttcatgcactaaagaaaagacaaaaaatgctgttgaaaagttcactgatgccaagagaagtttattgcaaactgagtcagatgctgaggaattagaaaggagagctcaggaaactgctgttaacctcgtcaaagctgatcagcagctaagatcgctccaggctgatgcaaaggatttggagcagcacaaaatcaagcaagaagaaatcttgaaagaaataaacaaaattgtagcagcaaaagactcagacttccaatgtttaagcaagaagaaggaaaaactgacagaagagcttcagaaactacagaaagacatagagatggcagaacgcaatgaggatcaccacctgcaggtccttaaagaatctgaggtgcttcttcaggccaaaagagccgagctggaaaagctgaaaagccaggtgacaagtcagcagcaggagatggctgtcttggacaggcagttagggcataaaaaggaggagctgcatctactccaaggaagcatggtccaggcaaaagctgacctccaggaagctctgagactgggagagactgaagtaactgagaagtgcaatcacattagggaagtaaaatctcttctggaagaactgagttttcagaaaggagaactaaatgttcagattagtgaaagaaaaactcaacttacacttataaagcaggaaattgaaaaagaggaagaaaatcttcaggttgttttaaggcagatgtctaaacataaaaccgaactaaagaatattctggacatgttgcaacttgaaaaccatgagctacaaggtttgaagctacaacatgaccaaagggtatctgaattagagaagactcaggtggcagtgctagaggagaaactggagttagagaatttgcagcagatatcccagcagcagaaaggggaaatagagtggcagaagcagctccttgagagggataaacgagaaatagaacgaatgactgctgagtcccgagctttacaatcgtgtgttgagtgtttgagcaaagaaaaggaagatctccaagagaaatgtgacatttgggaaaaaaagttggcacaaaccaaaagggttttagcagcagcagaagaaaatagcaaaatggagcaatcaaacttagaaaagttggaattgaatgtcagaaaactgcagcaggaactagaccaactaaacagagacaagttgtcactgcataacgacatttcagcaatgcaacagcagctccaagaaaaacgagaagcagtaaactcactgcaggaggaactagctaatgtccaagaccatttgaacctagcaaaacaggacctgcttcacaccaccaagcatcaggatgtgttgctcagtgagcagacccgactccagaaggacatcagtgaatgggcaaataggtttgaagactgtcagaaagaagaggagacaaaacaacaacaacttcaagtgcttcagaatgagattgaagaaaacaagctcaaactagtccaacaagaaatgatgtttcagagactccagaaagagagagaaagtgaagaaagcaaattagaaaccagtaaagtgacactgaaggagcaacagcaccagctggaaaaggaattaacagaccagaaaagcaaactggaccaagtgctctcaaaggtgctggcagctgaagagcgtgttaggactctgcaggaagaggagaggtggtgtgagagcctggagaagacactctcccaaactaaacggcagctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagcggagccagctggagaaaaaccttcttgagcaaaaacaggagaacagctgcatacaaaaggaaatggcaacaattgaactggtagcccaggacaaccatgagcgggccaggcgcctgatgaaggagctcaaccagatgcagtatgagtacacggagctcaagaaacagatggcaaaccaaaaagatttggagagaagacaaatggaaatcagtgatgcaatgaggacacttaaatctgaggtgaaggatgaaatcagaaccagcttgaagaatcttaatcagtttcttccagaactaccagcagatctagaagctattttggaaagaaacgaaaacctagaaggagaattggaaagcttgaaagagaaccttccatttaccatgaatgagggaccttttgaagaaaaactgaacttttcccaagttcacataatggatgaacactggcgtggagaagcactccgggagaaactgcgtcaccgggaagaccgactcaaggcccaactccgacactgtatgtccaagcaagcagaagtattaattaaaggaaagcggcagacagagggcactttacacagtttgaggagacaagtagatgctttaggggaattggtcaccagcacctctgcagattcagcgtcatcacccagtctgtctcagctggagtcttccctcacagaggactctcaacttggacaaaatcaggaaaagaatgcctcagccagatgaggaatactgtcttgtgtaaatatattcaaggaaaacacctccactacctcactgacttcataattggaatgtcacatggtttttttaatcaagatgcagtgaactgagattctgaaactccactgtagtttactttgcctgtaccattaatgccaatgtttttataaatcacttgtacatagtacatatgggaatagttgcatatgggaatttaaaccaacatgtggctgagcctttttttttttaatcttcgtaacatgtttaaaaaaaaacagtgattttaactgcatatttgaacctacaaactggtaaatcttattaacaaaaagaatgtacttaaggccctctttatttatagtgtcgagttatttttgaattttgcttaaaatctatttttcatatgaaaataaaagataacaatc

SEQ ID NO: 3 - DNA, 2719 bp, Homo sapiens
acttaaggtcggcgacccgaggccgcggctgccgactgggtcccctgccgctgtcgccaccatggctccgcaccgccccgcgcccgcgctgctttgcgcgctgtccctggcgctgtgcgcgctgtcgctgcccgtccgcgcggccactgcgtcgcggggggcgtcccaggcgggggcgccccaggggcgggtgcccgaggcgcggcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtgaaaaaaaaaaaaaaaaaaaaaaaaaaaaaaaaaaaaaaaaaaaaaaaaaaaaaaaaaaaaaaaaaaaaaa

SEQ ID NO: 4 - DNA, 2685 bp, Homo sapiens
tcccgcccgcgccctgcccaccccggccgcgcgcaccacaacgcccccgccccgccgcccggaaccagctgagcgcagctggacccagcagccgctgtctccagtgccgcagcagcaggtagtgctcatagctctctttgtccagtgcttcggccttggtcccagcgccttcccacggagcagcactcttcaccctgcacagccttgttagcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtgaaaaaaaaaaaaaaaaaaaaaaaaaaaaaa

SEQ ID NO: 5 - DNA, 1576 bp, Homo sapiens
atgtctgacaaactgccctacaaagttgctgacatcggcctggccacctggggacacaaggccctagacattgtggagaatggatgccgggtttgatgggcatgcaggagctttactcggcctccaggccactgaagggtgcctgcattgctgactgcctgcaaataactgtggagacggccatcctcattgagacccttttctccctgggtgttcaggagcagtggtctagctgcagcatcttctccacccaggaacatgcagtggctgtctttgccgaggctggcatgccagtgttcacctggaagggcaaaatgaaagaggggtacccgtggtgcattgaacagacactgtacttcaaggacgggcccctcaacatgattctggatgatgggggtgaccttaccaacctcatccacaccaagtacgtacccacagctcatgtcgggcatctgaggcatctctgaggagaccaaaaccggggtccacaacctacacaagatgatggccagtgcaatcctgaaggtgcctaccatcaacgtcaatgactccgtcaccaagagcaaaatttgacaacctctatggctgccaggagtcccttatagatgacaccaagtggaccaagacgtgatgattgccagcaaggtagcagtggtagcaggctatggtgatgtgggcaagggctgtgcccaggccttgcagggttttggggcctgcgtaatcatcaccgagactgaccccatcagtgcactgcaggctgccatggaaggctatgaggtgaccaccatggacgaggcctgtcaggagggcaacatctttgtcaccaccacaacctgtgtcaatatcatccttggccggcactttgagcagatgaaggatgatgccatcttatgtaatactgaacaatttgacgtggagatcgatgtcaggtgcctcaacaacaatgctgtggagaaggcaaacatcaagcccaggcggactggtactggctgaagaatgggtgccacatcatcgtgctggctgagggttggctggtcaacctgggctgtgctatgggccgccccagctttgtggggagtaactccttcaaccaggtgatggtgcagattgcgctgtggacccacccagacaagtaccccattggggttcacttcctgcccaagaagctggatgaggcagtggctgaggcgcccccctgggcaagctgaacgtgaaattgaccaagctaactgagaagcaagcccagtagctgagcacgtcccgtgatggccccttcaagccggatcactactgctgctgagagtcaggcctgcccttcactttccagctgctgtccttgctcaggccccgcctcttctccctaagagcaaatggcaccaactttgtgattggttggttagtgtcccccatcgatggggctggtcactcagtttttggcctctgctgcatccctaacactatatcaagtgtggcggggaaattgagaggcccctcctcaagccctggtcatgatggaggtacaagggaggcatccacaaggaaccatgagttgagtggtcttggaactgctcactaa

SEQ ID NO: 6 - DNA, 594 bp, Homo sapiens
atgtctgacaaactgccctacaaagttgctgacatcggcctggccacctggggacacaaggccctagacattgtggagaatggatgccggctgcagcatcttctccacccaggaacatgcagtggctgtctttgccgaggctggcatgccagtgttcacctggaagggcaaaatgaaagaggggtacccgtggtgcattgaacagacactctcatgtcgggcatctgaggcatctctgaggagaccaaaaccggggtccacaacctacacaagatgatggccagtgcaatcctgaaggtgcctaccatcaacgtcaatgactccgtcaccaagagcaaaatttgacaacctctatggctgccaggagtcccttatagatgacaccaagtggaccgtgatggtgcagattgcgctgtggacccacccagacaagtaccccattggggttcacttcctgcccaagaagctggatgaggcagtggctgaggcgcccccctgggcaagctgaacgtgaaattgaccaagctaactgagaagcaagcccagtagctgagcacgtcccgtgatggccccttcaagccggatcactactgc

SEQ ID NO: 7 - DNA, 699 bp, Homo sapiens
atggcccagccccctttgcccttgtccatcaaaggtgccgccagcatgtctgacaaactgccctacaaagttgctgacatcggcctggccacctggggacacaaggccctagacattgtggagaatggatgccgggaacatgcagtggctgtctttgccgaggctggcatgccagtgttcacctggaagggcaaaatgaaagaggggtacccgtggtgcattgaacagacactgtacttcaaggacgggcccctcaacatgattctggatgatgggggtgaccttaccaacctcatccacaccaaatgacaccaagtggaccaagacgtgatgattgccagcaaggtagcagtggtagcaggctatggtgatgtgggcaagggctgtgcccaggccttgcagggttttggggcctgcgtaatcatcaccgagactgaccccatcagtgcactgcaggctgccatggaaggctatgaggtgaccaccatggacgaggcctgtcaggagggcaacatctttgtcaccaccacaacctgtgtcaatatcatccttggccggcactttgagcagatgaaggatgatgccatcttatgtaatactgaacaatttgacgtggagatcgatgtcagctttgtggggagtaactccttcaaccagctgaacgtgaaattgaccaagctaactgagaagcaagcccag

SEQ ID NO: 8 - DNA, 6297 bp, Homo sapiens
atgaggagcctgccgagcctgggcggcctcgccctgttgtgctgcgccgccgccgccgccgccgccgccgtcgcctcagccgcctcggcggggaatgtcaccggtggcggcggggccgcggggcaggtggacgcgtcgccgggccccgggttgcggggcgagcccagccaccccttccctagggcgacggctcccacggcccaggccccgaggaccgggcccccgcgcgccaccgtccaccgacccctggctgcgacttctccagcccagtccccggagaccacccctctttgggcgactgctggaccctcttccaccacctttcaggcgccgctcggcccctcgccgaccacccctccggcggcggaacgcacttcgaccacctctcaggcgccgaccagacccgcgccgaccaccctttcgacgaccactggcccggcgccgaccacccctgtagcgaccaccgtaccggcgcccacgactccccggaccccgacccccgatctccccagcagcagcaacagcagcgtcctccccaccccacctgccaccgaggccccctcttcgcctcctccagggcatcagtggcctgtggcaaagatgccccaaaagtatctaggaaaatatgcctgtgagagtaacctgaaaagcaagtacttgcctcttacacagccagtcatgaatcttagagtctcagaagctgttaaaacggagtatgtatgtaactgctctgtggttggaagcctgaatgtgaatcgctgcaaccagaccacagggcagtgtgagtgtcggccaggttatcaggggcttcactgtgaaacctgcaaagagggcttttacctaaattacacttctgggctctgtcagccatgtgactgtagtccacatggagctctcagcataccgtgcaacagttctgggaaatgccagtgcaaagtgggtgtcattggctctatatgtgaccgatgccaagatggatattatggctttagtaagaatggctgcttgccctgccaatgcaataatcggtctgccagttgcgatgccctcacaggtgcttgtttaaactgccaggaaaatagcaaaggaaatcactgtgaagaatgtaaagaaggattttatcagagtcctgatgccactaaagaatgtcttcgctgcccttgttcagcagtgacatctacaggcagctgctctataaaatcgagtgaattggaacctgaatgtgaccagtgtaaagatggttacataggcccgaactgcaataaatgtgaaaatggctattacaattttgacagcatctgtagaaagtgccaatgtcacggccatgtggacccagttaaaactccaaagatttgtaagcccgagagtggtgagtgcatcaactgcctccataacaccactgggttttggtgtgagaactgcctagaaggttatgttcacgacctcgagggaaattgcatcaagaaagaagttattcttccaacacctgaaggttctaccattttggtttccaatgcctctttgaccacatcagtgcccacccctgttataaatagtacttttacccctacaaccctgcagactatcttttcagtaagcacttctgaaaacagcacttcagctttagctgatgtatcatggacccaatttaacatcatcattttgacagtcatcatcattgttgtggtgctgctaatgggatttgtgggggctgtatatatgtaccgcgagtaccaaaaccggaaactcaatgcccccttttggaccatcgagctgaaagaagacaatatcagtttcagcagctaccatgacagcattcccaatgcagatgtttcgggattgttggaagatgatggcaatgaagtggctcccaatgggcagctgaccctgacgacgcccatacataactacaaagcctaaggagctagaactgttctgaattgttaaaccacagtgcttgctaagacagagtcagcccctgggccagacaaagcctggctagagtttgctgagaaagcaaaggcaaatagtgcatctgaaattttcaggtacaaatttgtaatgcgcttagcctatctattgctcttagttttcccatgaagatctgaagcgttcactgtcattaggacttgaagtaaagtatatttttgtaccaaaccacatgggagtatggaaaggctgaaccccatagtgcagcccaaaaccactttgacctccagatagactcctggggaagcattcaccaagccagtggtaacaagatgatgaatgtggagggggaaaagactgctggaagacttcatctccattcctgaaacattttttttaaaacagtgtcagggattatattcgttttactatacaaaaggacatcattgaggaaaagcttgtttctaggctgtatcacagtaaataatcttgattgtttctagaacaggggtagaaaagtcccaagatcttcagaagggcttggttttttcctcccaggattcttgctcagtgatgagttgaaagcacaggataagcttctaagggaggaaggcagcattggggagcaggaggctgatggtcctcctcagggtctcagtgtaaatgataaattgtctaaaaataaggaatattcctgcctctagagaaataaggtgtacatagttaatgtagcatatctggtcgacgttgtatttgtatctatttgtaaaaaaaaaatcatgtcatattttatcatctggaatttatttgtacagcagttaatggtgttgtaaaaagaaaaatatggggattgcttaaaatactgtaaaatagatggcaatattgctagagctgggactctggtgagcatccgtcatttttagtccttcttgaggacattgctgaaatttataagaggtcgaatgtttctttctttcctttctcagtctaaaagtagagttatatgctctttgacttactatgattcaagcaatagattttgaagtcagtaatcgttaagctgggacataggatgcattctccaaaaacattaatctaattagacattagccaccctatatattttacatagattaatataaaacatatcctcattaaaaaatgtttttcttgaatgtaaaagatagtcttccaaaggatagaaatattttagttccaagagaaaagccatcatattacttgggatctgtagttttcatgcctatgaaatatttataatcctccctcaccccaaataaaaaatctcctacatgtgaacatagcctgtcactcatttgccatgaggtatgtgccatctccctgcagtgctatagttctcccattgtcttcctgtctggttaatgagcagctttgtagatgggtgtgtctagttagttcttgctttttgatggagttttttcctagaggccaactactgttgctctcgtttattatgatattgacattttgggttaagcaaggtgggtgggaaaggtggtcagatgttaaatataacttattaggaggaacagtgaactgtgaagtggttagaaaaaaaataaaaacttcttattagattagacctaggaaattcaagctgacccctttgcctaacttccctagagaaaaacctagaacttggtcatccctttataggagacccctaagttgttctcagggtttggagatgatgttctggagggagtacaagcaaataatctacttctggtaatctgagggtgctttgcgtatttggccattgctcagaagaatagaggttacattatattacattatatgaaaattatttagtttttctatagccctttgtagtttgcaaagcacttttccatatgtgtgtcctctcttccacaccatagccccctgaggaagtaattgttgtccccattttatagatgaaaaggctgaggcacagaggagctaaatatcttgttcaaggctatacaatgtgtgtgattattaggcttggaatcagggcctctaactctaaagcacatgttttttcaactatatgcagaaattgcctagccatggacacaagaaagctgggaggaagagttctacttgtggatgtttttaattttttttaaatatcaggagcaatccagggccatacagctatgaagcacttagtgaaaagaacacaagaagatttactaactgaagttagtattagtgattagaaaacaaaactgccagtttgtgcttcattaaggtgaactcatctctccaagcaggaagggaaaatttgctttccctagcagttgctgcatatgtgtgtacagactgcacaattctaagaaattgtgcaaaatggcatacctgtctttctcccagatacaccgccccctgccccccccaaaaaaggtcaggattaaaggtggtgagaagtgaacatttattaaacagaagttaaaccaatagagagaaaggaggtttgttggagtctaagaggattttgaccatgtagaaattccttgaaacagaccttaaaaggtattgaaaaattgaatcacaaagaaagtttacctttaaatacttgttaatggctcctagatcatggttataatttttctcaatgggaaaaaaagtcttaaaatttgttttaaataagatcctctaatgtctcgagctttttgattctggaaataatttgctttaaaatataaatcaatcagaaagtgatctaccactgaaatcattctaggaaactagcatgggatgcactgcacaatgttctttcctctaaaggcatgggccccataaactgtggcatctggcagcaggatgccatcagtcctttagaaagcctaattttgggccgggtgcggtggctcacgcctgtaatcccagcactttgggaggccgaggcgggtggatcacaaggtcaggagttcgagaccagcctggtcaacatggcgaaatcccgtctctactaaaaacacaaaaattagccgggtgtacgtgcctgtagtctcagctacttgggaggctgaggcaggagaatcacttgaacctgggaggcagaggttacagtgagccgagatggcgccatttcactccagcctgggcgacagagcaagactctgtctcaaaaaaaaggaagaaaaagaaagcctaatattgggagaatgtttgtgtaaggattggaaatctgtttatttttaaataagatagcactgatgtgaatcttatttggaaattacagatactgccattaagcgatgcttttatcttcattaattcattttggtaagcgcctatgcatttctgatggttaggtgccctaggtagtgttaagtatgtccgtgtcctcccttactcccctctcgctccctctaccctctatcccctagggttcttttattaatggaatttctccagttatagagaaaaaaatgacatttgaaaactaaagctcatttatattaatactaaggtcctgtgggcctagtgcgttactcttcccagtgatacctagattttaagagtagagaacagaggaaacatgggatgagaggagagaggttttttagacaacatttgtagacacctcaaattatatcactgttctctagcgccaatattcccaggtaaattgaccattaaagcaatactcactgacctactagtttattttggtcagctgagtaccatcaggatatttaaccctttaagtgctgttttgggagtagaaaactaaagcaacaatacttcctcttgacagctttgattggaatggggttattagatcattcaccttggtcctacactttttaggatgcttggtgaacataacaccacttataatgaacatccctggttcctatattttgggctatgtgggtaggaattgttacttgttactgcagcagcagccctagaaagtaagcccagggcttcagatctaagttagtccaaaagctaaatgatttaaagtcaagttgtaatgctaggcataagcactctataatacattaaattataggccgagcaattagggaatgtttctgaaacattaaacttgtatttatgtcactaaaattctaacacaaacttaaaaaatgtgtctcatacatatgctgtactaggcttcatcatgcatttctaaatttgtgtatgatttgaatatatgaaagaatttatacaagagtgttatttaaaattattaaaaataaatgtatataatttgtacctattgtagatttgttgtttacttttttgtgtggtcagagttgtttcatgtcttcaaatacatgccaaggatcatttactttcagcccacttcataaaaatctttgaactctt

SEQ ID NO: 9 - DNA, 1001 bp, Homo sapiens
gaaaaagatggcgccccgcgcccggggggccccttcctgagcgccccggcccctccctccgccgcctccccctcctccccgcggcgcccccgccccgccccgcccccgccgagaccccgaccccggccccacgggcggacactcggccgggcagccgcgggccgagcgcagccgcctccgccaccgatgcgcctggtggccagactccaagtgggaccggcggacacgcagcctcgcgtgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagagggtcagcagctctaagcaaagctgcctcgtgactttcgaagataattccaaatactgggtcctatggaaggacatacagcatgccggtgttccaggagaggagcccaagtgcaacatctgcctagggaagacatcagggccgctgaatgagatcctcatctgcgggaagtgtggcctgggttaccaccagcagtgccacatccccatagcgggcagtgctgaccagcccctgctcacaccttggttctgccgacgctgcatcttcgcactggctgtgcgggtgagccttccatcctccccagtccctgcctctcctgcctcctccagtggggcagaccagagactcccatcacagagtctgagctccaagcagaagggccacacctgggctttggagacagatagcgcctctgccactgtccttggccaggatttgtagactccctgagcctcagtttcctcaactgtaaagtggagatgggtttggtgtcgggaataacgggaccaataaatgatgctttactattaaaaaagaaaatccatgtaaataaaaaaaaaaaaaa

SEQ ID NO: 10 - DNA, 4287 bp, Homo sapiens
gaaaaagatggcgccccgcgcccggggggccccttcctgagcgccccggcccctccctccgccgcctccccctcctccccgcggcgcccccgccccgccccgcccccgccgagaccccgaccccggccccacgggcggacactcggccgggcagccgcgggccgagcgcagccgcctccgccaccgatgcgcctggtggccagactccaagtgggaccggcggacacgcagcctcgcgtgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagagggtcagcagctctaagcaaagctgcctcgtgactttcgaagataattccaaatactgggtcctatggaaggacatacagcatgccggtgttccaggagaggagcccaagtgcaacatctgcctagggaagacatcagggccgctgaatgagatcctcatctgcgggaagtgtggcctgggttaccaccagcagtgccacatccccatagcgggcagtgctgaccagcccctgctcacaccttggttctgccgacgctgcatcttcgcactggctgtgcggaaaggcggcgcgctgaagaagggcgccatcgccaggacgctgcaggccgtgaagatggtgctgtcctaccagcccgaggagctcgagtgggactcgccccatcgcaccaaccagcagcaatgctactgctactgcggcgggcccggagaatggtacctgcggatgctgcaatgttaccggtgcaggcagtggttccacgaggcctgcacccagtgcctcaatgagcccatgatgtttggagaccggttttacctgttcttctgctccgtgtgtaaccagggcccagagtacatcgagaggctgcccctgcgatgggtggatgtggttcacctggccctctataatctgggggtacagagcaagaagaagtactttgactttgaggagattctggcctttgtcaaccaccactgggagctcctgcagcttggcaagctcaccagcaccccagtgacagatcgaggaccacatctcctcaacgctctgaacagttataaaagccggttcctctgcggcaaggagatcaagaagaagaagtgcatcttccgcctgcgcatccgcgtcccacccaacccgccagggaagctgctgcctgacaaaggactgctgccaaatgagaacagcgcctcctctgagctgcgtaagagaggaaagagcaagcctggtttgttgcctcacgaattccagcagcagaaaaggcgagtttatagaagaaaaagatcaaagtttttgctggaagatgctattcccagtagtgacttcacctcagcctggagcaccaaccaccacctggctagcatatttgacttcacgctggatgaaattcaaagtttaaaaagtgccagctcaggccagaccttcttctcagatgtcgactccaccgacgctgccagcacctctggctctgcctccaccagcctctcctatgactccagatggacagtgggcagccgaaagaggaagctggcagccaaggcatacatgcccctgcgggcaaagcggtgggcagctgagctggatggacgctgcccctcggacagcagtgcagagggggcttcagtccccgagcggccagacgaaggcattgacagccacacatttgagagcatcagtgaagatgactcatccctgtcccacctcaagtcatctatcaccaactactttggtgcagctgggcggttggcctgtggggagaagtaccaggtgttggctcggagggtcacacctgagggcaaggttcagtacctggtggagtgggaagggaccaccccttactgactagcccccgggggtgccaggggtcctgaaaaccaaaggaggagcagcagaagccataggctccccagctttctccaggctggggtgggagaaggaagcaggacagagctgcaagtgcctggcagaatgccctgcctgcctgcctgccaggccaaggcctgcgtctctctgctgtaccagctctgttccagggcctcctcaggctcgttacccctgtgcctgtgtctctacacactccacaccccctcaaactctgtttatctgttctctgaccttgtgtcccctgcgctgggacccttcctcctgaggcccaggtctttgtccccagttgtgtgccttgacctctctcgcccctttctgggtgtgttcgcacatcctgtgtgtgcacagctgtccctccactggatccccttcacacgtgacccgtggggcagccagtcctcccagggactacataacaggcacctttgagagagcatgggagaaggtggataagaggatgctgctcagtgcttttctcttccactttcctgccactccccactaccctcggagagaggtggtgggatgggagagagcccctgtgaaagcctgtgaggatctgaagagtaaagggctgggtctgcctcagaaggcaccagcaccagggcccaggtattaaggctgagagtgaaggctgccaatgtcagctttggaggtcccagaagtcttctgttctctggcctcaccccctcagtcgccatagagctgggcctggccttgctggaatggaggcatccttccaaacctgggggacgggggtggggggtggtagtggtgggagggaaaccatgtcttgctaaacctgtttctggtgcctcccatccccagacccaccagacaccacacagcagacaatacacacccactcgcacaagcttccatccacatgtgttgtactttcagctctaggcatgcagacaaccccacacggccacaccaccacatgcccaagtgtacacacacagagccacaccgtccctctgggcctgctggctcctcccttggctttcccttggcccacttccagggcccaggtgctgcaactaaatgtgaaagctcagtggccgctccttctttcagcccatcaaccagcattggtcccatagggaagcacaggggactcaccctctttcatatcccttgccctgccctgaaatggacaatcactttttgggataggttgaaatttttaaagagcctgcatcatttggttccctcaaagggaagcccttgccagtgggggtttgaaagagaatttttggaaccaacattcaaattctgcctcatctggagggaaaccaaaattgggagggggaagaggacccctgatgttttgctgcttccagagatattagaaactgactcacttgattggaaaatggacaaaagtgccttgacgtggagggtgggcaccagatggggaccagccttgccaactgctgctgtggcctccagcttggctggttttgcaggccgccagcaggaaggcgaaggtggtagtacagcaagaggcactggcggggcagcaggcctgcaggagctgtttttccattgctaggcctgacccctctctacctgtgagcgttcagggggtccctgagatagtttagatgcccccccatcttagacctcagctcccacagtgccttttaagggggacctcacctcctgtgcacagcccacccactttcctctgcttccctggcacagcccaggcatagacgagctggcgttggacccagttcttcccccttttcagccccacagctgctgccacaggggccaactagggccaggtggaaggggagctgagaagccaacccctagcccaggggtgctgtgggaactgggatccaatttgtagcttcctgcctggcttcagagagcccagcaaccttctaggcctgctttccagacttctgagatagcctgggatgagcaatcctgttatagtacatctggaccttccctacctgggctctggggaggctgtgggcctggagagggaaaaggagggagggggtgtctgcaccacctgggaagatagcacaaggcctaatgaggtcaccctgactccccaccccagcatttcattcataccagataatagctgcattactgccaactgaccttataaccctctgcaccttcaaaaagattcatggtttttaattgctgcttttaataacatttgttaaagttataattaatgtgtctgatttatgatttaaaacctccctttgaacaat

SEQ ID NO: 11 - DNA, 3411 bp, Homo sapiens
ccctgcgtcggggggcaagatggcagcccaggctttggcgctgctgagagaggtagcgaggctggaagcgccgctggaggagctacgcgcgcttcactccgtgctgcaggcagtgccgctcaacgagcttcgccagcaagcggcggagctgcgcctcggcccgctcttctccctgcttaacgagaaccatagggaaaagactactttgtgtgtatccattctggagagattgctccaagctatggaaccggttcacgtggcccggaacctcagggttgacctgcagaggggactaattcaccctgatgattctgtaaaaatcctcactctttcccagattggaagaattgttgaaaattctgatgctgttactgagattctaaataatgctgaattactaaaacaaattgtttattgcattggtggagagaatctatctgtagcaaaagcggctatcaaatccctgtcaagaatatcactaacccaagctggactggaggctttatttgaaagcaatctgctggatgatttgaaaagtgtaatgaaaacaaatgacattgttcgatacagggtgtatgagctaattatagagatttcttccgtgtcaccagaatctttaaactactgtaccacaagtggattggtaacccagctcctgagagagctgactggtgaggatgtgttggtcagagccacctgtatagaaatggtgacatcactggcatatactcatcatgggcgacaatatcttgctcaagaaggagtaattgaccaaatttctaatataattgttggggcagattcagaccctttctctagcttctatctgccaggattcgtgaagttttttggaaacctggctgtcatggatagtcctcaacagatctgtgagcgttatcctatctttgtggaaaaagtctttgaaatgatagaaagtcaggaccccactatgattggtgtagctgtagacacagttggaatcttgggatccaatgttgaaggaaaacaggttttacagaaaacaggaactcgctttgaacgcttgcttatgagaataggacatcaatcaaagaatgccccagtggagctaaaaattagatgtttggatgcaatttcatctcttctgtacttaccacctgagcagcagactgatgaccttctgaggatgacagaatcctggttttcttctttatctcgggatccactggagctcttccgtggcattagtagtcagcccttccctgaactacactgtgctgccttaaaagtgtttacggccattgcaaaccaaccctgggctcagaaacttatgtttaacagtccaggttttgtagaatatgtggtggaccggtctgtggagcatgacaaagcttcaaaggatgccaaatatgaactagtgaaagcacttgccaattccaagacaattgcagaaatctttgggaacccaaattatttgaggctcagaacttacctgagtgaagggccatactatgtgaaacctgtttccacgacagcagtagaaggagccgaatgatttcttctagagctcatgtagaggaccacgttttgaccaaaacttctcctaaggcatttgactccatctatatttcacaaaagagacttcctttccccaagaattatcatggaatgtcagatgttactttgttaccaacactgttatatttctacattgaaatgcaaagtggaactaggagtttggaatgcattaagagcagacaagcttggtcataatagatccagtgtttttcagattcctttcactgccttaatctttgcaacagggtggaagtttttttcttccctcaaaattttcatggacatgcaatcttatctaaaagcctgcttcagggctgggcgcggtggctaacacctataattcccagcactttgggaggccaagatgggcaaatcacttgagtctaggagttcaagaccagcctggccaatatggcaaaaccctgtctctactaaaaatataaaatcagccaggcatggtggcgcacacctataatctcagctactcaggaggctgaggcacgagaatcgcttgagcctgggaggcagaggttgcagtgagctgagatcttgccactgcacaccagcctgggcaacacagcaagactctgtctcaaaaataaatgaataaaataaaaacctgccaccaaattatttctggattctcttcactatctttttttttctttttggtcctttttccatttctgattccactttcaaagtcttggatatattctttgaaaaatgagtagtatggaatattaagattatgttccttatactcagaatactttttatgagctctcttgtttttttgttactattattcctttgaaaaaaagacaaaatatctaaaaaatgtttatagtgttcatgtaattttttttgctgtttaccaatgaactttgccctgttgtggttttgggggatcagaaggattcctaaactgtcatttcatttattggtaggtcatgattgctgagggttttgctttggatttttcatacctataaagtcaatcttgagttgatcagagaaagggaaacttactcctaataaacagactcagaacagaagggacatatgcataaatcaggataccatctcattaatttacaaaggataatctttcttttcattgacaacacctacacccacctgttttccagtgttcttctctctaaacagcaaagccaaagcactctgcacaccaaatcacctgttcagaggtttatgcatgagcatatttcttttaggccgtggtgaagttgataaaccacccctgctttgtaacaaaattattttaaagtgactggaattatctagtccccagattgatcatctcccctggcaacgtgactctgttttttgtgtgtgtttccatgctgactagtcccctactgttaatatcactactaattaggctataaccaggtctttcctggcctgagaaatattctcttaaaatgacctttgttttaatctcattcatgatgttgattttttttcaatgtggtgcaatatatacaataaaatttgtcataactattttaagtgtacagttcagtatattacatatgttcataagttgtacaaccatcaccaccatccatcttcagaattattttcatcttatacaattgaaactgtattcattaaacaataactgtctattccctcttttccccagcctctggcaaccaccattctgcttcatgacattgattttattcacttaacatcagattttggggggatgccctctctcctatgtatggtctacacattctgattttttttttagattgaataaaatttgtaaatcattattttcatttcataagtaaaaaaaaaaaaaaaaaaaaaaaaaaa

SEQ ID NO: 12 - DNA, 4078 bp, Homo sapiens
cactgcacatgcgcccctctcaagtgctggcagaccactgtgcatgcagacaacgcacccaaagggaagaatcaggggaacagtaacgcaaccctgccagcatgccaatgtagaaaacttgaaagaatgaacacaaaaatgtttacaaaggatatcatggcagagtgccaccatggcaactgcaccatacaactactcttacatctttaaatatattattattggggacatgggagtaggaaaatcttgcttgcttcatcaatttacagaaaaaaaatttatggctgattgtcctcacacaattggtgttgaatttggtacaagaataatcgaagttagtggccaaaaaataaaactgcagatttgggatacggcaggacaggagcgatttagggctgttacacggagctactacagaggagctgcgggagctcttatggtctatgatatcactagaagaagtacatataaccacttaagcagctggttgacagatgcaaggaatctcaccaatccaaatactgtaataattctcataggaaataaagcagatttggaggcacagagagatgttacatatgaagaagccaaacagtttgctgaagaaaatggcttattgttcctcgaagcgagtgcaaaaacgggagagaatgtagaagatgccttccttgaggctgccaagaaaatctatcagaacattcaggatggaagcttggatctgaatgctgctgagtctggtgtacaacacaaaccttcagccccgcagggaggccggctaaccagtgaaccccaaccccagagagaaggctgtggctgctagtgacctctttgctgtggcccctcatttgacctttcacctctgtctgttggaagcagtactttttactgcctcattgtcttctgtacatcttactgggtttaattaaaaaaaaagaaaaaactctgttgtaaaaacagtttaacacaatactaaactgctaaacaactagatgtaatcaggttatcaaaggcaagtagagtaataaatctctcctgcatggtaaatctagactttttttcccccttgtcctcgtgataagtatgtcaccaatatatgatttaaaccgagcactgatgctggacttcatgatttttaccctccctttggcaaggctttgtctcactgtacggtttaatttggtgatatcttaagcctttcttcccatccttaactgttcaagtatgtctgttgtaaccaataagtttattgctgtgaaattacttctgatggtagagaaggggttctataactgcttttgttttgttttggataaatttcctgttgtgtgggtggcatttttcttaacgagatttgcttctgtcttagcctcacacagggaaaatatccatttatcttctctctcgtgcttaattaatagctttatctttttttataccattttatccttttctctttaacagaaagtaaatatgtataaaatttgaaggaatcgaactaacaatacattctgtgtatattattttaatgaagaaaataaattgattactggcattggaacagtataaaataccagtttgtacagtatgacctatatgtgaccatgttactcccttccatttcacacaaagaaatagacacaactgcagttcacaagtagtactggctccaccccttggtgctggcagtgtttggggacattatgctggaaagagctcctagcatcagaggattaacactagcagattctgttccatctttgcactgttgcttacctgctgattttcttaactgttcttgtgcaatcgacaatgtgctaacctgcttttctctttttgtaaacgtttttgcattacaggctgcattcttgccttactgtatagaaaaagaaaaaaggctgggtttactattgcacattttaagcttttatacctttatcttcttggaatggtcagattctgaactggacagtcagaaccacaggtctgctgttaagggattttaaattgtgcatttttaaccctacagtgaaataacttaagatatccctgtgttcacagtgtgaggggctgttttatgtcatgttggcataaattgttttgtaaaagggaaagtgtttctaaaggtgtttcagcgcttgtgctgatacaaagtaagttattactttgcaccaggtggtttggccactgaattaatactgtatagcaagagaaacaatcttatttttttggacaacatgttttattaagttcttcatttctgttgattttttttattgcatttatgattcagtggctgggaattgagaatttatttgaaatagaataggtaacacctcagcgtactatagaaaatgcactcagctcaactgctgtgtttaaaatacacattttaaatccctctttacagacactaacataaaagtacatctttctgggttgtaaacatgtggtagtaccagagtattgtatagtcaatgttaaataaaagccaaaactggaatgtgcagaaagtaggctttggttaatttgtggattcatttttatttttgtctttgtttaactttttaaaaaataagatttctggagtagattggtatattctgttaaagacttacagtgatccattttgcttacactgttgcatcacaagggactcacccagggaccatgacctgctggtgtgtgtgtatatttacaaaaacaaaacaaacaaaccacccattgggatataaggtagcaatcacaaactaaagactgcggcttgttgaggtgcaataccctgactcccaaagttagttacagtgggttttattgtttttgtgactgaaggatttattcagactgctgtactcttcatttgatgtaacaaaatgctattaatctaaatatttgtaaataaagtacctgtatctagattaaattaaaattggttgcattattttctgaactataatagggtttttcttcaggtgaacaatttgacgtgtcatcagtttttattgcagcactgtccatattcattgtataaagagaggtctacgtatgtagcatataaaaccacatcactaagtaatagacccacagctttattcttgtgtttacattacccttgaaatgttttcagtcaacccttttcagtgtaagatcagcacatttggtggctgatgctgttctcctttgactgtaccgggagccagattctatcatatgcatgtgtaatcccctgtaatacactcaggtgctcacaaatagagcagattgtcatattgtaacatgcgtgtgccagacaccgggcagtacactttggaaagaatgtgaaatccttttaatttttaatccatagcttactgcttgtgcagtcacctgcctctcgaggttgctcattgcccttggacctgtgaggaggccctcagattagtaattggtgcttagtactatttatgcttaaatagatcttccactacaatgttgaagtcttttttatggataataacgtgtttgatggagtaacttattatttttttttggttggtggtttacacgttaatagaggtagtacaatttctttggaaaggtgtcttttgaagccagctgttaagcttcatacattacctcccttctcaaattcggtaagacagtagttttggggaacttttttgcccatgtgtcttttaagtgtgattttaaaaaaatgagtcgttcagttcattcccctaaacagaagaaaagaccaaataattaccttccattcctcttcatgtgggaatatagagagggttcatgtggcattttagagaaaagataatttatcctcattcaacacaggcccagaaaattgtgtcccagaaggatgtcagtaattgtgactaggccaggccttttagcattttgctaagacttgaaacaaaaaatgtaaatacaaaagaaatcaagttttgttttgaaagatgccttctagaacttactgtgtattaataaattgtcactttcattgtctttattgtaactccattgatcccgtatcttaacggttcacgtctagccaaataactgttttggaataaaaaccttggtggtg

SEQ ID NO: 13 - DNA, 4343 bp, Homo sapiens
ggcgcgagcgcccgtggggcgggcctcagcggcggcgcgacaagtccagaggtgagggctgaggaaggggcgtggctagcgggctggcctcagccaccctcttccgggctccgccagctgcgcgcgcatcttctcccccttcttttgtggtccggcccattgcgagggtgacaggaaaccctgtgcagggagcgccgccatcttggaccagcccgaggaagatactgagggagcacaggagcagtcaccgctgccactgctactgccgctactgctgccggcgcgtctgcacctctcggcctgccagtgtacctgccggcgcctcggtcgaccgcccccgccccctctcccgctgcgtccgcactcctgttcctggtcctgacgcccccctcccgcccggaaagctgcccagccaccagcaaccccccagtgccaccatggcaactgcaccatacaactactcttacatctttaaatatattattattggggacatgggagtaggaaaatcttgcttgcttcatcaatttacagaaaaaaaatttatggctgattgtcctcacacaattggtgttgaatttggtacaagaataatcgaagttagtggccaaaaaataaaactgcagatttgggatacggcaggacaggagcgatttagggctgttacacggagctactacagaggagctgcgggagctcttatggtctatgatatcactagaagaagtacatataaccacttaagcagctggttgacagatgcaaggaatctcaccaatccaaatactgtaataattctcataggaaataaagcagatttggaggcacagagagatgttacatatgaagaagccaaacagtttgctgaagaaaatggcttattgttcctcgaagcgagtgcaaaaacgggagagaatgtagaagatgccttccttgaggctgccaagaaaatctatcagaacattcaggatggaagcttggatctgaatgctgctgagtctggtgtacaacacaaaccttcagccccgcagggaggccggctaaccagtgaaccccaaccccagagagaaggctgtggctgctagtgacctctttgctgtggcccctcatttgacctttcacctctgtctgttggaagcagtactttttactgcctcattgtcttctgtacatcttactgggtttaattaaaaaaaaagaaaaaactctgttgtaaaaacagtttaacacaatactaaactgctaaacaactagatgtaatcaggttatcaaaggcaagtagagtaataaatctctcctgcatggtaaatctagactttttttcccccttgtcctcgtgataagtatgtcaccaatatatgatttaaaccgagcactgatgctggacttcatgatttttaccctccctttggcaaggctttgtctcactgtacggtttaatttggtgatatcttaagcctttcttcccatccttaactgttcaagtatgtctgttgtaaccaataagtttattgctgtgaaattacttctgatggtagagaaggggttctataactgcttttgttttgttttggataaatttcctgttgtgtgggtggcatttttcttaacgagatttgcttctgtcttagcctcacacagggaaaatatccatttatcttctctctcgtgcttaattaatagctttatctttttttataccattttatccttttctctttaacagaaagtaaatatgtataaaatttgaaggaatcgaactaacaatacattctgtgtatattattttaatgaagaaaataaattgattactggcattggaacagtataaaataccagtttgtacagtatgacctatatgtgaccatgttactcccttccatttcacacaaagaaatagacacaactgcagttcacaagtagtactggctccaccccttggtgctggcagtgtttggggacattatgctggaaagagctcctagcatcagaggattaacactagcagattctgttccatctttgcactgttgcttacctgctgattttcttaactgttcttgtgcaatcgacaatgtgctaacctgcttttctctttttgtaaacgtttttgcattacaggctgcattcttgccttactgtatagaaaaagaaaaaaggctgggtttactattgcacattttaagcttttatacctttatcttcttggaatggtcagattctgaactggacagtcagaaccacaggtctgctgttaagggattttaaattgtgcatttttaaccctacagtgaaataacttaagatatccctgtgttcacagtgtgaggggctgttttatgtcatgttggcataaattgttttgtaaaagggaaagtgtttctaaaggtgtttcagcgcttgtgctgatacaaagtaagttattactttgcaccaggtggtttggccactgaattaatactgtatagcaagagaaacaatcttatttttttggacaacatgttttattaagttcttcatttctgttgattttttttattgcatttatgattcagtggctgggaattgagaatttatttgaaatagaataggtaacacctcagcgtactatagaaaatgcactcagctcaactgctgtgtttaaaatacacattttaaatccctctttacagacactaacataaaagtacatctttctgggttgtaaacatgtggtagtaccagagtattgtatagtcaatgttaaataaaagccaaaactggaatgtgcagaaagtaggctttggttaatttgtggattcatttttatttttgtctttgtttaactttttaaaaaataagatttctggagtagattggtatattctgttaaagacttacagtgatccattttgcttacactgttgcatcacaagggactcacccagggaccatgacctgctggtgtgtgtgtatatttacaaaaacaaaacaaacaaaccacccattgggatataaggtagcaatcacaaactaaagactgcggcttgttgaggtgcaataccctgactcccaaagttagttacagtgggttttattgtttttgtgactgaaggatttattcagactgctgtactcttcatttgatgtaacaaaatgctattaatctaaatatttgtaaataaagtacctgtatctagattaaattaaaattggttgcattattttctgaactataatagggtttttcttcaggtgaacaatttgacgtgtcatcagtttttattgcagcactgtccatattcattgtataaagagaggtctacgtatgtagcatataaaaccacatcactaagtaatagacccacagctttattcttgtgtttacattacccttgaaatgttttcagtcaacccttttcagtgtaagatcagcacatttggtggctgatgctgttctcctttgactgtaccgggagccagattctatcatatgcatgtgtaatcccctgtaatacactcaggtgctcacaaatagagcagattgtcatattgtaacatgcgtgtgccagacaccgggcagtacactttggaaagaatgtgaaatccttttaatttttaatccatagcttactgcttgtgcagtcacctgcctctcgaggttgctcattgcccttggacctgtgaggaggccctcagattagtaattggtgcttagtactatttatgcttaaatagatcttccactacaatgttgaagtcttttttatggataataacgtgtttgatggagtaacttattatttttttttggttggtggtttacacgttaatagaggtagtacaatttctttggaaaggtgtcttttgaagccagctgttaagcttcatacattacctcccttctcaaattcggtaagacagtagttttggggaacttttttgcccatgtgtcttttaagtgtgattttaaaaaaatgagtcgttcagttcattcccctaaacagaagaaaagaccaaataattaccttccattcctcttcatgtgggaatatagagagggttcatgtggcattttagagaaaagataatttatcctcattcaacacaggcccagaaaattgtgtcccagaaggatgtcagtaattgtgactaggccaggccttttagcattttgctaagacttgaaacaaaaaatgtaaatacaaaagaaatcaagttttgttttgaaagatgccttctagaacttactgtgtattaataaattgtcactttcattgtctttattgtaactccattgatcccgtatcttaacggttcacgtctagccaaataactgttttggaataaaaaccttggtggtg

SEQ ID NO: 14 - DNA, 4165 bp, Homo sapiens
ggcgcgagcgcccgtggggcgggcctcagcggcggcgcgacaagtccagaggtgagggctgaggaaggggcgtggctagcgggctggcctcagccaccctcttccgggctccgccagctgcgcgcgcatcttctcccccttcttttgtggtccggcccattgcgagggtgacaggaaaccctgtgcagggagcgccgccatcttggaccagcccgaggaagatactgagggagcacaggagcagtcaccgctgccactgctactgccgctactgctgccggcgcgtctgcacctctcggcctgccagtgtacctgccggcgcctcggtcgaccgcccccgccccctctcccgctgcgtccgcactcctgttcctggtcctgacgcccccctcccgcccggaaagctgcccagccaccagcaaccccccagtgccaccatggcaactgcaccatacaactactcttacatctttaaatatattattattggggacatgggagtaggaaaatcttgcttgcttcatcaatttacagaaaaaaaataagaagtacatataaccacttaagcagctggttgacagatgcaaggaatctcaccaatccaaatactgtaataattctcataggaaataaagcagatttggaggcacagagagatgttacatatgaagaagccaaacagtttgctgaagaaaatggcttattgttcctcgaagcgagtgcaaaaacgggagagaatgtagaagatgccttccttgaggctgccaagaaaatctatcagaacattcaggatggaagcttggatctgaatgctgctgagtctggtgtacaacacaaaccttcagccccgcagggaggccggctaaccagtgaaccccaaccccagagagaaggctgtggctgctagtgacctctttgctgtggcccctcatttgacctttcacctctgtctgttggaagcagtactttttactgcctcattgtcttctgtacatcttactgggtttaattaaaaaaaaagaaaaaactctgttgtaaaaacagtttaacacaatactaaactgctaaacaactagatgtaatcaggttatcaaaggcaagtagagtaataaatctctcctgcatggtaaatctagactttttttcccccttgtcctcgtgataagtatgtcaccaatatatgatttaaaccgagcactgatgctggacttcatgatttttaccctccctttggcaaggctttgtctcactgtacggtttaatttggtgatatcttaagcctttcttcccatccttaactgttcaagtatgtctgttgtaaccaataagtttattgctgtgaaattacttctgatggtagagaaggggttctataactgcttttgttttgttttggataaatttcctgttgtgtgggtggcatttttcttaacgagatttgcttctgtcttagcctcacacagggaaaatatccatttatcttctctctcgtgcttaattaatagctttatctttttttataccattttatccttttctctttaacagaaagtaaatatgtataaaatttgaaggaatcgaactaacaatacattctgtgtatattattttaatgaagaaaataaattgattactggcattggaacagtataaaataccagtttgtacagtatgacctatatgtgaccatgttactcccttccatttcacacaaagaaatagacacaactgcagttcacaagtagtactggctccaccccttggtgctggcagtgtttggggacattatgctggaaagagctcctagcatcagaggattaacactagcagattctgttccatctttgcactgttgcttacctgctgattttcttaactgttcttgtgcaatcgacaatgtgctaacctgcttttctctttttgtaaacgtttttgcattacaggctgcattcttgccttactgtatagaaaaagaaaaaaggctgggtttactattgcacattttaagcttttatacctttatcttcttggaatggtcagattctgaactggacagtcagaaccacaggtctgctgttaagggattttaaattgtgcatttttaaccctacagtgaaataacttaagatatccctgtgttcacagtgtgaggggctgttttatgtcatgttggcataaattgttttgtaaaagggaaagtgtttctaaaggtgtttcagcgcttgtgctgatacaaagtaagttattactttgcaccaggtggtttggccactgaattaatactgtatagcaagagaaacaatcttatttttttggacaacatgttttattaagttcttcatttctgttgattttttttattgcatttatgattcagtggctgggaattgagaatttatttgaaatagaataggtaacacctcagcgtactatagaaaatgcactcagctcaactgctgtgtttaaaatacacattttaaatccctctttacagacactaacataaaagtacatctttctgggttgtaaacatgtggtagtaccagagtattgtatagtcaatgttaaataaaagccaaaactggaatgtgcagaaagtaggctttggttaatttgtggattcatttttatttttgtctttgtttaactttttaaaaaataagatttctggagtagattggtatattctgttaaagacttacagtgatccattttgcttacactgttgcatcacaagggactcacccagggaccatgacctgctggtgtgtgtgtatatttacaaaaacaaaacaaacaaaccacccattgggatataaggtagcaatcacaaactaaagactgcggcttgttgaggtgcaataccctgactcccaaagttagttacagtgggttttattgtttttgtgactgaaggatttattcagactgctgtactcttcatttgatgtaacaaaatgctattaatctaaatatttgtaaataaagtacctgtatctagattaaattaaaattggttgcattattttctgaactataatagggtttttcttcaggtgaacaatttgacgtgtcatcagtttttattgcagcactgtccatattcattgtataaagagaggtctacgtatgtagcatataaaaccacatcactaagtaatagacccacagctttattcttgtgtttacattacccttgaaatgttttcagtcaacccttttcagtgtaagatcagcacatttggtggctgatgctgttctcctttgactgtaccgggagccagattctatcatatgcatgtgtaatcccctgtaatacactcaggtgctcacaaatagagcagattgtcatattgtaacatgcgtgtgccagacaccgggcagtacactttggaaagaatgtgaaatccttttaatttttaatccatagcttactgcttgtgcagtcacctgcctctcgaggttgctcattgcccttggacctgtgaggaggccctcagattagtaattggtgcttagtactatttatgcttaaatagatcttccactacaatgttgaagtcttttttatggataataacgtgtttgatggagtaacttattatttttttttggttggtggtttacacgttaatagaggtagtacaatttctttggaaaggtgtcttttgaagccagctgttaagcttcatacattacctcccttctcaaattcggtaagacagtagttttggggaacttttttgcccatgtgtcttttaagtgtgattttaaaaaaatgagtcgttcagttcattcccctaaacagaagaaaagaccaaataattaccttccattcctcttcatgtgggaatatagagagggttcatgtggcattttagagaaaagataatttatcctcattcaacacaggcccagaaaattgtgtcccagaaggatgtcagtaattgtgactaggccaggccttttagcattttgctaagacttgaaacaaaaaatgtaaatacaaaagaaatcaagttttgttttgaaagatgccttctagaacttactgtgtattaataaattgtcactttcattgtctttattgtaactccattgatcccgtatcttaacggttcacgtctagccaaataactgttttggaataaaaaccttggtggtg

SEQ ID NO: 15 - DNA, 4449 bp, Homo sapiens
gtaaagtggtggcacctgaccggagcatgtagccacctatgacttcctgagtggggtggtgtggggagggccctgaggagtctgtggtcctaggccttggatttcatcagggctttcctgctccttctggttgcctcagtcccaggcaagatagggtcccagaatcttacagcccagaggccacctgttgcaacttcttttttacagatggagtcatcagaacccactgtgaggaagtgacttctccttgaggtcacccagacactccaaacagagcagagcaaaagcgcctagaacttgaaattttggacctgtctccaacaccctggggatttccaccaggaagccttcagtcaccatccaggggatttttatcgccacaaagggtaattcctgctccatccctgctgtgactcagctgtgacgttgaaccacacaagccagagagaagaagataaagtcatcagagctcctactcaccagagagtgaggcccaggccaggactccacaaggctggtcccctgccctggagcaacttaaacaggccctctggccagcctggaaccctgagatggcctccagctcaggcagcagtcctcgcccggcccctgatgagaatgagtttccctttgggtgccctcccaccgtctgccaggacccaaaggagcccagggctctctgctgtgcaggctgtctctctgagaacccgaggaatggcgaggatcagatctgccccaaatgcagaggggaagacctccagtctataagcccaggaagccgtcttcgaactcaggagaaggctcaccccgaggtggctgaggctggaattgggtgcccctttgcaggtgtcggctgctccttcaagggaagcccacagtctgtgcaagagcatgaggtcacctcccagacctcccacctaaacctgctgttggggttcatgaaacagtggaaggcccggctgggctgtggcctggagtctgggcccatggccctggagcagaacctgtcagacctgcagctgcaggcagccgtggaagtggcgggggacctggaggtcgattgctaccgggcaccctgctccgagagccaggaggagctggccctgcagcacttcatgaaggagaagcttctggctgagctggaggggaagctgcgtgtgtttgagaacattgttgctgtcctcaacaaggaggtggaggcctcccacctggccctggccacctctatccaccagagccagctggaccgtgagcgcatcctgagcttggagcagagggtggtggagcttcagcagaccctggcccagaaagaccaggccctgggcaagctggagcagagcttgcgcctcatggaggaggcctccttcgatggcactttcctgtggaagatcaccaatgtcaccaggcggtgccatgagtcggcctgtggcaggaccgtcagcctcttctccccagccttctacactgccaagtatggctacaagttgtgcctgcggctgtacctgaatggagatggcactggaaagagaacccatctgtcgctcttcatcgtgatcatgagaggggagtatgatgcgctgctgccgtggcccttccggaacaaggtcaccttcatgctgctggaccagaacaaccgtgagcacgccattgacgccttccggcctgacctaagctcagcgtccttccagaggccccagagtgaaaccaacgtggccagtggatgcccactcttcttccccctcagcaaactgcagtcacccaagcacgcctacgtgaaggacgacacaatgttcctcaagtgcattgtggagaccagcacttagggtgggcggggctcctgagggagctccaactcagaagggagctagccagaggactgtgatgccctgcccttggcacccaagacctcagggcacaaagatgggtgaaggctggcatgatccaagcaagactgaggggtcgacttcgggctggccatctggttaggatggcaggacgtgggctgggcccacaaaggcaaagggtccagaaggagacaggcagagctgctcccctctgcacggaccatgcgacactgggaggccagtgagccactccggccccgaatgttgaggtggactctcaccaaatgagaagaaaatggaaccaggcttggaaccgtaggacccaagcagagaagctctcgggctaggaagatctctgcagggccgccagggagacctggacacaggcctgctctctttttctccagggtcagaaacaggaccgggtggaagggatggggtgccagtttgaatgcagtctgtccaggctcgtcattggaggtgaacaagcaaacccagacggctccactaggacttcaaattgggggttggatttgaagacttttaagtttccttccagcccagaaagtctctcattctaggcctcctggcccaggtgagtcctagagctacaggggttctggaaacattcaggagcttcctgtcctcccagctcctcactcaccttcagtaacccccactggactgacctggtccacagggcacctgccaccctgggcctggcagctcagcttccccaacacgcaggagcacacccagcccccacatcctgtgcctccatcagctaaacaccacgtcacttcatgcaggtgaaacccagtcactgtgagctcccaggtgcagccagaggcacctcaagaagaagaggggcataaactttcctcttcctgcctagaggccccacctttggtgctttccagaatcccgtaacacctgattaactgaggcatccacttctttcagcagactgatcaggacctccaagccactgagcaatgtataaccccaaagaaataatttttagaatctctttcgaagttttcctaaagtgtatggtttgggagttgtttgtactgagccaggtttgaaaaggccattgctgagtttgaggtggtgccaccagttttgcaggtggcatcagaggctggcatgctggcaggaacatcccctcttagccccagtcttctcttttctataatgagacccaccccagcttgcctccctccctggcttctctgaccctcaaaggagatgccacgcaggacagactggagagagaagcctgggcaatactgcccgcctgtcatggcctggtggtggcccacacctatcttctcaccttggaggccacacccaactttccaaagaccctgagacaagtcaggaccctactactctcccctgctgctttcctgacagcttactcttcctccacctgctgagcctgtgccagactccattgctcaaatcgttagggttgcttctataaaaatgggtcagtagcccttcctgttctctccagcccagcatacaggaggatcaaaggaggtgacggagcatcgtggcacggcagtctcaatgggtcagaaacccaggccagctgggctctaagcctggcatcctgtcatgcttagtccttcagctgaagatcagaggaagcctctcccttgccctctccagctctaggggttttcaggaggcccaactgcaataatggagcactagtgcttttatgtgcaatggtgtcgtccatgcacgacagcagcaaacattctggggctgctttttattgttcccacggctgacagcgtggcagcggagactgtggaggcagtggagactgacttcttcctgctgacagctggatgtcacacatgaaggtctggcctagcgagtgatgggtctaggccctgaaactgatgtcctagcaataacctcttgatccctactcaccgagtgttgagcccaaggggggatttgtagaacaagcccccatgagaaacagctgttactctacacttttgattgcctatttctgatggcaagagatacatactctcttcaaagagcatgagatgcagccattctttcagcaaagcttcattgacacctgcacctgttaactgtgttcgacattgaagggagaaaggcaagatgtgcactctggactcaagaaactcttagttcagtggaggaaatgagcagataagtagatcattatgattgagagtaggagaagcttagagaaagcacagaatcccagatccagctggtgaaggagggaaggcttcaggcctttaagctcagcctgagaatattgtgaaatgcagaggatggggaaaagggaagagtaccgacttgaaaacggagagctgtcttggctgagggcagggtctgtgtggcaggatgggggagggagtcagaagggtcagatgaactggagtgtagacagcatcagatgcagcagtgcccaccgccccccccccaaccccccgccctgcccacagagcacctgctggtaaccctgggcctattgaaagcaggatgagatgataatttaagacactgaatgatttcttttccaacaaagctctatgttaagtgc

SEQ ID NO: 16 - DNA, 3527 bp, Homo sapiens
taaaaaaaatcttagtgtctgcaaaacaggtgggtttaagatttattgatattagggaaagtgaaattaatgagctactcaagtttctgtctttggtcatcactgagagtctatttccataggaagaagtctttgcagaggaaattgaatgctgtctgatgctacaattcatatggatcctttcctggattgaagcctgacttttaaaaaaggtttcaataaattgcttatacctatgaagagatgcaaaagaaccttcaaaataaagcaaaggacttgaagaaagagaaggaagacatgaagaagaggatgtcatttaggtgaagggccatgctggataaggagctggctgcctctgtgaacatcctactcaaggcatcttcactgctgtacatccttttgaaatcccagagatcttcagtctccctgtggattaaggagatgtgcagtatttaaagtggcttcaggaaggcatggaagaggactgagtggggaaagctttttgtgcatgctgctggctacctccagcggctgcctccagcctccatcagctgcactctggggaagaggaggctgccttctacctcccagcatctctggatttcatgttcctgtcagcacagaggagctaaatggcctgtagaggctgaaggtctgaggctcctaaagctggaagaaaaggctgggccagtcaggccaagcaagaacacagtgtaacttgtctctgagtgcttcatggttaagggggctaagcaggcacaagggcatgaggatggttatatgtacagactgaggggaagaagcagtgaagatgagacttgccatcttcttgagtcagtaggcctgcctcaggtgcctaggatgtaattgctctgctgcttctcatggggaggagtggccctcatgaccttgtttacctggaagagtgtgggatgaatgcctcctcctatggggactcgcaagtgctttagcaaaaggataaattgctaattgtggcatttcgtggatcagcaggattatttctccttgctaaagaggattttgttggtcctgaattctgaggaggtgggactaggaatgggctccatgagcctgtgtatgactcagggaatattaggactttggcacagcctcatgggttgggagtaagtcttggctcttccctagcctgaatgacagacatcagatcattctggtgctttgtccatgaagatgtagattctgagcccacccaactaatcttttcacttgagcacagaaacagccccgggaatcggacagacccgtgtctttcaggtttgcttcacagagccccaggggttgacaataggtgccttggagactgcctgcatggggatttttaaaaagctttctttgttaaaggtttgtaaaccactcctctgagcctgttttcattttatagattattcagggaactgaactgcacagagatccagaaagtgggtagtgcaggctgtagtgctgataactactgtactacttggatctttgtgctcccaaataccaaatggaagaggatctctgagagtcctttgcaaagatcttgtagggactttaggctggggccttcggaaaattccagaggattccaatggagattttgagggactgactcagaagaacaaagagaatgataatggtgatgtccctgctttttacaacagatcatgttctgatatatatgcaaatctgtgtaaagtaaaccctacctaaaatgtactggggacccaagatggactgcctgtattgcttccaggataaagtccaatttctagctctggtttttataaccttgcttcagctcaccttttccgtcatcatcccctccatctcctctcccacgctgggaaatggatggctgcactatactgtgtgatgttattgctatgttcatgccatcccctctgcctggaatgcccttctgcatgaatgcctgtgaaatgttgttgctcctttgtatggcctggcttccgtggttggcaggaatctcttctttcgtggtattcctgtcatctttgtgcatcacagtcagctttgtattcctagcttgtaagctacttgaggataggggcatgtctgaatctatttaatctcttgcacctgtttggcaaattgatgttttaagtatttaaataactaaagctctctctacagtacatactcacttttgatttatgaattggcaaaattcaacttttttccttgaatattcttaaagtgagatgaattccaaaggagagtgttctgtgtgtggccttcattgagtggttttctgttaccagaaagctcttggtggccttcctcttccctggtgtcaaggttgactgttataggaaatgggaggggagagggccgtttctgccacgcattgtcctaggttcttaacattatttaatccttataatgcaatgttatcctcattttacagatgaaacctgagaccaaagaacatgtaacacataaagtacattgcagagttaggatgtgaacccaactctgattctaaacctaatgctctcactctttcattcagaggttcagtcagttctttgtaggctgtagatccagagaagctgccgtagccaacaatgaagttgttagtttttaaaacatctatgtggtaagttggtctggcacttaaaaatgtattgtttcccaggcacggtggttcacacctgtaatcccagcattttgggaggccgaggcaggcggatcattaggtcaaaagattgagaccatcctgaccaacatggtgaaaccccgtctctactaaaagtacaaaaattagctgggtgtggtggcgcatgcctctagtcccagctacctgggaggctgaggcaggagaattgcttgaacccaggaggcagaggttgcagtgagccaagatcatgctactgcactacagcctggcaacaaagcgagactctgtctaaaatatatatatatatatatattgtttactactcaccacagatctgcaggagttcactgatctctaggatctgccttaactccaacttacatgttttggtcactattacaaactgtcatcccagaatgatgctgcagaggctagggctaggacacagaccagtgtttccatgtgggaattccctcccagtatttcttaggaaatgtatgttttttgaatccataatccctagaaaaatcagttgaggaaatgagaagtattgtaattattctgtgaatagtaacacttaccattatggagacatcactagtttgaaagaatccaacttcatcaaatattaacgtaccgagttgaaggctacaagaactgagacaggagcatagcagagagaaacggtcaccatctcattagccctatttttggttgttgtgatgccattacatctgtatatctggccatatcagctgctaatggtgagttcttgcaaacaaaatgatttgataaacaacctaccatactttatacaaatcttatggtgttccgagaaataaactttggaagcaaaataagttaa

SEQ ID NO: 17 - protein, 1676 aa, Homo sapiens
MGLLGILCFLIFLGKTWGQEQTYVISAPKIFRVGASENIVIQVYGYTEAFDATISIKSYPDKKFSYSSGHVHLSSENKFQNSAILTIQPKQLPGGQNPVSYVYLEVVSKHFSKSKRMPITYDNGFLFIHTDKPVYTPDQSVKVRVYSLNDDLKPAKRETVLTFIDPEGSEVDMVEEIDHIGIISFPDFKIPSNPRYGMWTIKAKYKEDFSTTGTAYFEVKEYVLPHFSVSIEPEYNFIGYKNFKNFEITIKARYFYNKVVTEADVYITFGIREDLKDDQKEMMQTAMQNTMLINGIAQVTFDSETAVKELSYYSLEDLNNKYLYIAVTVIESTGGFSEEAEIPGIKYVLSPYKLNLVATPLFLKPGIPYPIKVQVKDSLDQLVGGVPVTLNAQTIDVNQETSDLDPSKSVTRVDDGVASFVLNLPSGVTVLEFNVKTDAPDLPEENQAREGYRAIAYSSLSQSYLYIDWTDNHKALLVGEHLNIIVTPKSPYIDKITHYNYLILSKGKIIHFGTREKFSDASYQSINIPVTQNMVPSSRLLVYYIVTGEQTAELVSDSVWLNIEEKCGNQLQVHLSPDADAYSPGQTVSLNMATGMDSWVALAAVDSAVYGVQRGAKKPLERVFQFLEKSDLGCGAGGGLNNANVFHLAGLTFLTNANADDSQENDEPCKEILRPRRTLQKKIEEIAAKYKHSVVKKCCYDGACVNNDETCEQRAARISLGPRCIKAFTECCVVASQLRANISHKDMQLGRLHMKTLLPVSKPEIRSYFPESWLWEVHLVPRRKQLQFALPDSLTTWEIQGVGISNTGICVADTVKAKVFKDVFLEMNIPYSVVRGEQIQLKGTVYNYRTSGMQFCVKMSAVEGICTSESPVIDHQGTKSSKCVRQKVEGSSSHLVTFTVLPLEIGLHNINFSLETWFGKEILVKTLRVVPEGVKRESYSGVTLDPRGIYGTISRRKEFPYRIPLDLVPKTEIKRILSVKGLLVGEILSAVLSQEGINILTHLPKGSAEAELMSVVPVFYVFHYLETGNHWNIFHSDPLIEKQKLKKKLKEGMLSIMSYRNADYSYSVWKGGSASTWLTAFALRVLGQVNKYVEQNQNSICNSLLWLVENYQLDNGSFKENSQYQPIKLQGTLPVEARENSLYLTAFTVIGIRKAFDICPLVKIDTALIKADNFLLENTLPAQSTFTLAISAYALSLGDKTHPQFRSIVSALKREALVKGNPPIYRFWKDNLQHKDSSVPNTGTARMVETTAYALLTSLNLKDINYVNPVIKWLSEEQRYGGGFYSTQDTINAIEGLTEYSLLVKQLRLSMDIDVSYKHKGALHNYKMTDKNFLGRPVEVLLNDDLIVSTGFGSGLATVHVTTVVHKTSTSEEVCSFYLKIDTQDIEASHYRGYGNSDYKRIVACASYKPSREESSSGSSHAVMDISLPTGISANEEDLKALVEGVDQLFTDYQIKDGHVILQLNSIPSSDFLCVRFRIFELFEVGFLSPATFTVYEYHRPDKQCTMFYSTSNIKIQKVCEGAACKCVEADCGQMQEELDLTISAETRKQTACKPEIAYAYKVSITSITVENVFVKYKATLLDIYKTGEAVAEKDSEITFIKKVTCTNAELVKGRQYLIMGKEALQIKYNFSFRYIYPLDSLTWIEYWPRDTTCSSCQAFLANLDEFAEDIFLNGC

SEQ ID NO: 18 - protein, 2325 aa, Homo sapiens
MKKGSQQKIFSKAKIPSSSHSPIPSSMSNMRSRSLSPLIGSETLPFHSGGQWCEQVEIADENNMLLDYQDHKGADSHAGVRYITEALIKKLTKQDNLALIKSLNLSLSKDGGKKFKYIENLEKCVKLEVLNLSYNLIGKIEKLDKLLKLRELNLSYNKISKIEGIENMCNLQKLNLAGNEIEHIPVWLGKKLKSLRVLNLKGNKISSLQDISKLKPLQDLISLILVENPVVTLPHYLQFTIFHLRSLESLEGQPVTTQDRQEAFERFSLEEVERLERDLEKKMIETEELKSKQTRFLEEIKNQDKLNKSLKEEAMLQKQSCEELKSDLNTKNELLKQKTIELTRACQKQYELEQELAFYKIDAKFEPLNYYPSEYAEIDKAPDESPYIGKSRYKRNMFATESYIIDSAQAVQIKKMEPDEQLRNDHMNLRGHTPLDTQLEDKEKKISAAQTRLSELHDEIEKAEQQILRATEEFKQLEEAIQLKKISEAGKDLLYKQLSGRLQLVNKLRQEALDLELQMEKQKQEIAGKQKEIKDLQIAIDSLDSKDPKHSHMKAQKSGKEQQLDIMNKQYQQLESRLDEILSRIAKETEEIKDLEEQLTEGQIAANEALKKDLEGVISGLQEYLGTIKGQATQAQNECRKLRDEKETLLQRLTEVEQERDQLEIVAMDAENMRKELAELESALQEQHEVNASLQQTQGDLSAYEAELEARLNLRDAEANQLKEELEKVTRLTQLEQSALQAELEKERQALKNALGKAQFSEEKEQENSELHAKLKHLQDDNNLLKQQLKDFQNHLNHVVDGLVRPEEVAARVDELRRKLKLGTGEMNIHSPSDVLGKSLADLQKQFSEILARSKWERDEAQVRERKLQEEMALQQEKLATGQEEFRQACERALEARMNFDKRQHEARIQQMENEIHYLQENLKSMEEIQGLTDLQLQEADEEKERILAQLRELEKKKKLEDAKSQEQVFGLDKELKKLKKAVATSDKLATAELTIAKDQLKSLHGTVMKINQERAEELQEAERFSRKAAQAARDLTRAEAEIELLQNLLRQKGEQFRLEMEKTGVGTGANSQVLEIEKLNETMERQRTEIARLQNVLDLTGSDNKGGFENVLEEIAELRREVSYQNDYISSMADPFKRRGYWYFMPPPPSSKVSSHSSQATKDSGVGLKYSASTPVRKPRPGQQDGKEGSQPPPASGYWVYSPIRSGLHKLFPSRDADSGGDSQEESELDDQEEPPFVPPPGYMMYTVLPDGSPVPQGMALYAPPPPLPNNSRPLTPGTVVYGPPPAGAPMVYGPPPPNFSIPFIPMGVLHCNVPEHHNLENEVSRLEDIMQHLKSKKREERWMRASKRQSEKEMEELHHNIDDLLQEKKSLECEVEELHRTVQKRQQQKDFIDGNVESLMTELEIEKSLKHHEDIVDEIECIEKTLLKRRSELREADRLLAEAESELSCTKEKTKNAVEKFTDAKRSLLQTESDAEELERRAQETAVNLVKADQQLRSLQADAKDLEQHKIKQEEILKEINKIVAAKDSDFQCLSKKKEKLTEELQKLQKDIEMAERNEDHHLQVLKESEVLLQAKRAELEKLKSQVTSQQQEMAVLDRQLGHKKEELHLLQGSMVQAKADLQEALRLGETEVTEKCNHIREVKSLLEELSFQKGELNVQISERKTQLTLIKQEIEKEEENLQVVLRQMSKHKTELKNILDMLQLENHELQGLKLQHDQRVSELEKTQVAVLEEKLELENLQQISQQQKGEIEWQKQLLERDKREIERMTAESRALQSCVECLSKEKEDLQEKCDIWEKKLAQTKRVLAAAEENSKMEQSNLEKLELNVRKLQQELDQLNRDKLSLHNDISAMQQQLQEKREAVNSLQEELANVQDHLNLAKQDLLHTTKHQDVLLSEQTRLQKDISEWANRFEDCQKEEETKQQQLQVLQNEIEENKLKLVQQEMMFQRLQKERESEESKLETSKVTLKEQQHQLEKELTDQKSKLDQVLSKVLAAEERVRTLQEEERWCESLEKTLSQTKRQLSEREQQLVEKSGELLALQKEADSMRADFSLLRNQFLTERKKAEKQVASLKEALKIQRSQLEKNLLEQKQENSCIQKEMATIELVAQDNHERARRLMKELNQMQYEYTELKKQMANQKDLERRQMEISDAMRTLKSEVKDEIRTSLKNLNQFLPELPADLEAILERNENLEGELESLKENLPFTMNEGPFEEKLNFSQVHIMDEHWRGEALREKLRHREDRLKAQLRHCMSKQAEVLIKGKRQTEGTLHSLRRQVDALGELVTSTSADSASSPSLSQLESSLTEDSQLGQNQEKNASAR

SEQ ID NO: 19 - protein, 782 aa, Homo sapiens
MAPHRPAPALLCALSLALCALSLPVRAATASRGASQAGAPQGRVPEARPNSMVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 20 - protein, 731 aa, Homo sapiens
MVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 21 - protein, 127 aa, Homo sapiens
MPGLMGMQELYSASRPLKGACIADCLQITVETAILIETLFSLGVQEQWSSCSIFSTQEHAVAVFAEAGMPVFTWKGKMKEGYPWCIEQTLYFKDGPLNMILDDGGDLTNLIHTKYVPTAHVGHLRHL

SEQ ID NO: 22 - protein, 63 aa, Homo sapiens [sequence omitted]

SEQ ID NO: 23 - protein, 123 aa, Homo sapiens [sequence omitted]

SEQ ID NO: 24 - protein, 639 aa, Homo sapiens
MRSLPSLGGLALLCCAAAAAAAAVASAASAGNVTGGGGAAGQVDASPGPGLRGEPSHPFPRATAPTAQAPRTGPPRATVHRPLAATSPAQSPETTPLWATAGPSSTTFQAPLGPSPTTPPAAERTSTTSQAPTRPAPTTLSTTTGPAPTTPVATTVPAPTTPRTPTPDLPSSSNSSVLPTPPATEAPSSPPPGHQWPVAKMPQKYLGKYACESNLKSKYLPLTQPVMNLRVSEAVKTEYVCNCSVVGSLNVNRCNQTTGQCECRPGYQGLHCETCKEGFYLNYTSGLCQPCDCSPHGALSIPCNSSGKCQCKVGVIGSICDRCQDGYYGFSKNGCLPCQCNNRSASCDALTGACLNCQENSKGNHCEECKEGFYQSPDATKECLRCPCSAVTSTGSCSIKSSELEPECDQCKDGYIGPNCNKCENGYYNFDSICRKCQCHGHVDPVKTPKICKPESGECINCLHNTTGFWCENCLEGYVHDLEGNCIKKEVILPTPEGSTILVSNASLTTSVPTPVINSTFTPTTLQTIFSVSTSENSTSALADVSWTQFNIIILTVIIIVVVLLMGFVGAVYMYREYQNRKLNAPFWTIELKEDNISFSSYHDSIPNADVSGLLEDDGNEVAPNGQLTLTTPIHNYKA

SEQ ID NO: 25 - protein, 207 aa, Homo sapiens
MENRALDPGTRDSYGATSHLPNKGALAKVKNNFKDLMSKLTEGQYVLCRWTDGLYYLGKIKRVSSSKQSCLVTFEDNSKYWVLWKDIQHAGVPGEEPKCNICLGKTSGPLNEILICGKCGLGYHQQCHIPIAGSADQPLLTPWFCRRCIFALAVRVSLPSSPVPASPASSSGADQRLPSQSLSSKQKGHTWALETDSASATVLGQDL

SEQ ID NO: 26 - protein, 580 aa, Homo sapiens
MENRALDPGTRDSYGATSHLPNKGALAKVKNNFKDLMSKLTEGQYVLCRWTDGLYYLGKIKRVSSSKQSCLVTFEDNSKYWVLWKDIQHAGVPGEEPKCNICLGKTSGPLNEILICGKCGLGYHQQCHIPIAGSADQPLLTPWFCRRCIFALAVRKGGALKKGAIARTLQAVKMVLSYQPEELEWDSPHRTNQQQCYCYCGGPGEWYLRMLQCYRCRQWFHEACTQCLNEPMMFGDRFYLFFCSVCNQGPEYIERLPLRWVDVVHLALYNLGVQSKKKYFDFEEILAFVNHHWELLQLGKLTSTPVTDRGPHLLNALNSYKSRFLCGKEIKKKKCIFRLRIRVPPNPPGKLLPDKGLLPNENSASSELRKRGKSKPGLLPHEFQQQKRRVYRRKRSKFLLEDAIPSSDFTSAWSTNHHLASIFDFTLDEIQSLKSASSGQTFFSDVDSTDAASTSGSASTSLSYDSRWTVGSRKRKLAAKAYMPLRAKRWAAELDGRCPSDSSAEGASVPERPDEGIDSHTFESISEDDSSLSHLKSSITNYFGAAGRLACGEKYQVLARRVTPEGKVQYLVEWEGTTPY

SEQ ID NO: 27 - protein, 504 aa, Homo sapiens
MAAQALALLREVARLEAPLEELRALHSVLQAVPLNELRQQAAELRLGPLFSLLNENHREKTTLCVSILERLLQAMEPVHVARNLRVDLQRGLIHPDDSVKILTLSQIGRIVENSDAVTEILNNAELLKQIVYCIGGENLSVAKAAIKSLSRISLTQAGLEALFESNLLDDLKSVMKTNDIVRYRVYELIIEISSVSPESLNYCTTSGLVTQLLRELTGEDVLVRATCIEMVTSLAYTHHGRQYLAQEGVIDQISNIIVGADSDPFSSFYLPGFVKFFGNLAVMDSPQQICERYPIFVEKVFEMIESQDPTMIGVAVDTVGILGSNVEGKQVLQKTGTRFERLLMRIGHQSKNAPVELKIRCLDAISSLLYLPPEQQTDDLLRMTESWFSSLSRDPLELFRGISSQPFPELHCAALKVFTAIANQPWAQKLMFNSPGFVEYVVDRSVEHDKASKDAKYELVKALANSKTIAEIFGNPNYLRLRTYLSEGPYYVKPVSTTAVEGAE

SEQ ID NO: 28 - protein, 215 aa, Homo sapiens
MATAPYNYSYIFKYIIIGDMGVGKSCLLHQFTEKKFMADCPHTIGVEFGTRIIEVSGQKIKLQIWDTAGQERFRAVTRSYYRGAAGALMVYDITRRSTYNHLSSWLTDARNLTNPNTVIILIGNKADLEAQRDVTYEEAKQFAEENGLLFLEASAKTGENVEDAFLEAAKKIYQNIQDGSLDLNAAESGVQHKPSAPQGGRLTSEPQPQREGCGC

SEQ ID NO: 29 - protein, 215 aa, Homo sapiens; identical to SEQ ID NO: 28

SEQ ID NO: 30 - protein, 143 aa, Homo sapiens
IYYYWGHGSRKILLASSIYRKKIRSTYNHLSSWLTDARNLTNPNTVIILIGNKADLEAQRDVTYEEAKQFAEENGLLFLEASAKTGENVEDAFLEAAKKIYQNIQDGSLDLNAAESGVQHKPSAPQGGRLTSEPQPQREGCGC

SEQ ID NO: 31 - protein, 416 aa, Homo sapiens
MASSSGSSPRPAPDENEFPFGCPPTVCQDPKEPRALCCAGCLSENPRNGEDQICPKCRGEDLQSISPGSRLRTQEKAHPEVAEAGIGCPFAGVGCSFKGSPQSVQEHEVTSQTSHLNLLLGFMKQWKARLGCGLESGPMALEQNLSDLQLQAAVEVAGDLEVDCYRAPCSESQEELALQHFMKEKLLAELEGKLRVFENIVAVLNKEVEASHLALATSIHQSQLDRERILSLEQRVVELQQTLAQKDQALGKLEQSLRLMEEASFDGTFLWKITNVTRRCHESACGRTVSLFSPAFYTAKYGYKLCLRLYLNGDGTGKRTHLSLFIVIMRGEYDALLPWPFRNKVTFMLLDQNNREHAIDAFRPDLSSASFQRPQSETNVASGCPLFFPLSKLQSPKHAYVKDDTMFLKCIVETST

SEQ ID NO: 32 - protein, 120 aa, Homo sapiens
SQLPGRLRQENCLNPGGRGCSEPRSCYCTTAWQQSETLSKIYIYIYIVYYSPQICRSSLISRICLNSNLHVLVTITNCHPRMMLQRLGLGHRPVFPCGNSLPVFLRKCMFFESIIPRKIS

SEQ ID NO: 33 - DNA, 201 bp, Homo sapiens
caaactgaatttggttgctactcctcttttcctgaagcctgggattccatatcccatcaaggtgcaggttaaagattcgcttgaccagttggtaggaggartcccagtaacactgaatgcacaaacaattgatgtaaaccaagagacatctgacttggatccaagcaaaagtgtaacacgtgttgatgatggagtagcttc

SEQ ID NO: 34 - DNA, 201 bp, Homo sapiens
tttccagaaagctggttgtgggaagttcatcttgttcccagaagaaaacagttgcagtttgccctacctgattctctaaccacctgggaaattcaaggcgrtggcatttcaaacactggtatatgtgttgctgatactgtcaaggcaaaggtgttcaaagatgtcttcctggaaatgaatataccatattctgttgtacga

SEQ ID NO: 35 - DNA, 201 bp, Homo sapiens
ctttggcacgagggagaaattttcagatgcatcttatcaaagtataaacattccagtaacacagaacatggttccttcatcccgacttctggtctattacytcgtcacaggagaacagacagcagaattagtgtctgattcagtctggttaaatattgaagaaaaatgtggcaaccagctccaggttcatctgtctcctga

SEQ ID NO: 36 - DNA, 201 bp, Homo sapiens
ccactacagaggctacggaaactctgattacaaacgcatagtagcatgtgccagctacaagcccagcagggaagaatcatcatctggatcctctcatgcgrtgatggacatctccttgcctactggaatcagtgcaaatgaagaagacttaaaagcccttgtggaaggggtggatcaactattcactgattaccaaatcaa

SEQ ID NO: 37 - DNA, 201 bp, Homo sapiens
tcttttgcaagagaagaaaagcttagagtgtgaagtagaagaattacatagaactgtccagaaacgtcaacagcaaaaggacttcattgatggaaatgttwagagtcttatgactgaactagaaatagaaaaatcactcaaacatcatgaagatattgtagatgaaattgagtgcattgagaagactcttctgaaacgtcg

SEQ ID NO: 38 - DNA, 201 bp, Homo sapiens
atcccatcatctatgtccaatatgagatctaggtcactttcacctttgattggatcagagactctaccttttcattctggaggacagtggtgtgagcaagktgagattgcagatgaaaacaatatgcttttggactatcaagaccataaaggagctgattcacatgcaggagttagatatattacagaggccctcattaaa

SEQ ID NO: 39 - DNA, 201 bp, Homo sapiens
atattccagtatggttagggaagaagttaaaatctttgcgagtcctcaatttgaaaggcaacaagatatcatcgctccaagatataagcaagttgaaaccycttcaagatttgatttctctgatcctagttgaaaatccagttgtgacccttcctcattacctccagtttaccattttccacctccgttcattggaaagtt

SEQ ID NO: 40 - DNA, 201 bp, Homo sapiens
atcccatcatctatgtccaatatgagatctaggtcactttcacctttgattggatcagagactctaccttttcattctggaggacagtggtgtgagcaagrtgagattgcagatgaaaacaatatgcttttggactatcaagaccataaaggagctgattcacatgcaggagttagatatattacagaggccctcattaaa

SEQ ID NO: 41 - DNA, 201 bp, Homo sapiens
ctaccttttcattctggaggacagtggtgtgagcaagttgagattgcagatgaaaacaatatgcttttggactatcaagaccataaaggagctgattcacktgcaggagttagatatattacagaggccctcattaaaaaacttactaaacaggataatttggctttgataaaatctctgaacctttcactttctaaagac

SEQ ID NO: 42 - DNA, 201 bp, Homo sapiens
catggatgacgatggcacaggccagaaacagatctggagaatcgaaggttccaacaaggtgcccgtggaccctgccacatatggacagttctatggaggcyacagctacatcattctgtacaactaccgccatggtggccgccaggggcagataatctataactggcagggtgcccagtctacccaggatgaggtcgctgc

SEQ ID NO: 43 - DNA, 201 bp, Homo sapiens
gtggagaagttcgatctggtgcccgtgcccaccaacctttatggagacttcttcacgggcgacgcctacgtcatcctgaagacagtgcagctgaggaacgyaaatctgcagtatgacctccactactggctgggcaatgagtgcagccaggatgagagcggggcggccgccatctttaccgtgcagctggatgactacctg

SEQ ID NO: 44 - DNA, 201 bp, Homo sapiens; identical to SEQ ID NO: 42

SEQ ID NO: 45 - DNA, 201 bp, Homo sapiens
tgcagccaggatgagagcggggcggccgccatctttaccgtgcagctggatgactacctgaacggccgggccgtgcagcaccgtgaggtccagggcttcgygtcggccaccttcctaggctacttcaagtctggcctgaagtacaagaaaggaggtgtggcatcaggattcaagcacgtggtacccaacgaggtggtggtg

SEQ ID NO: 46 - DNA, 201 bp, Homo sapiens
cgagcggagtggccgggcccgagtgcacgtgtctgaggagggcactgagcccgaggcgatgctccaggtgctgggccccaagccggctctgcctgcaggtwccgaggacaccgccaaggaggatgcggccaaccgcaagctggccaagctctacaaggtctccaatggtgcagggaccatgtccgtctccctcgtggctga

SEQ ID NO: 47 - DNA, 201 bp, Homo sapiens
agcatggtggtggaacaccccgagttcctcaaggcagggaaggagcctggcctgcagatctggcgtgtggagaagttcgatctggtgcccgtgcccaccamcctttatggagacttcttcacgggcgacgcctacgtcatcctgaagacagtgcagctgaggaacggaaatctgcagtatgacctccactactggctgggc

SEQ ID NO: 48 - DNA, 201 bp, Homo sapiens
ccagtgcaatcctgaaggtgcctaccatcaacgtcaatgactccgtcaccaagagcaaaatttgacaacctctatggctgccaggagtcccttatagatgrcaccaagtggaccaagacgtgatgattgccagcaaggtagcagtggtagcaggctatggtgatgtgggcaagggctgtgcccaggccttgcagggttttg

SEQ ID NO: 49 - DNA, 201 bp, Homo sapiens
tgacaacctctatggctgccaggagtcccttatagatgacaccaagtggaccaagacgtgatgattgccagcaaggtagcagtggtagcaggctatggtgrtgtgggcaagggctgtgcccaggccttgcagggttttggggcctgcgtaatcatcaccgagactgaccccatcagtgcactgcaggctgccatggaaggc

SEQ ID NO: 50 - DNA, 201 bp, Homo sapiens
ggaccaagacgtgatgattgccagcaaggtagcagtggtagcaggctatggtgatgtgggcaagggctgtgcccaggccttgcagggttttggggcctgcrtaatcatcaccgagactgaccccatcagtgcactgcaggctgccatggaaggctatgaggtgaccaccatggacgaggcctgtcaggagggcaacatctt

SEQ ID NO: 51 - DNA, 201 bp, Homo sapiens
cagtgcaatcctgaaggtgcctaccatcaacgtcaatgactccgtcaccaagagcaaaatttgacaacctctatggctgccaggagtcccttatagatgaraccaagtggaccgtgatggtgcagattgcgctgtggacccacccagacaagtaccccattggggttcacttcctgcccaagaagctggatgaggcagtgg

SEQ ID NO: 52 - DNA, 201 bp, Homo sapiens; identical to SEQ ID NO: 51

SEQ ID NO: 53 - DNA, 201 bp, Homo sapiens
acccgtggtgcattgaacagacactgtacttcaaggacgggcccctcaacatgattctggatgatgggggtgaccttaccaacctcatccacaccaaatgrcaccaagtggaccaagacgtgatgattgccagcaaggtagcagtggtagcaggctatggtgatgtgggcaagggctgtgcccaggccttgcagggttttg

SEQ ID NO: 54 - DNA, 201 bp, Homo sapiens
atgggggtgaccttaccaacctcatccacaccaaatgacaccaagtggaccaagacgtgatgattgccagcaaggtagcagtggtagcaggctatggtgargtgggcaagggctgtgcccaggccttgcagggttttggggcctgcgtaatcatcaccgagactgaccccatcagtgcactgcaggctgccatggaaggct

SEQ ID NO: 55 - DNA, 201 bp, Homo sapiens
gaccaagacgtgatgattgccagcaaggtagcagtggtagcaggctatggtgatgtgggcaagggctgtgcccaggccttgcagggttttggggcctgcgraatcatcaccgagactgaccccatcagtgcactgcaggctgccatggaaggctatgaggtgaccaccatggacgaggcctgtcaggagggcaacatcttt

SEQ ID NO: 56 - DNA, 201 bp, Homo sapiens
cggcccctcgccgaccacccctccggcggcggaacgcacttcgaccacctctcaggcgccgaccagacccgcgccgaccaccctttcgacgaccactggcscggcgccgaccacccctgtagcgaccaccgtaccggcgcccacgactccccggaccccgacccccgatctccccagcagcagcaacagcagcgtcctccc

SEQ ID NO: 57 - DNA, 201 bp, Homo sapiens
tcctacactttttaggatgcttggtgaacataacaccacttataatgaacatccctggttcctatattttgggctatgtgggtaggaattgttacttgttrctgcagcagcagccctagaaagtaagcccagggcttcagatctaagttagtccaaaagctaaatgatttaaagtcaagttgtaatgctaggcataagcac

SEQ ID NO: 58 - DNA, 201 bp, Homo sapiens
catcttcgcactggctgtgcgggtgagccttccatcctccccagtccctgcctctcctgcctcctccagtggggcagaccagagactcccatcacagagtytgagctccaagcagaagggccacacctgggctttggagacagatagcgcctctgccactgtccttggccaggatttgtagactccctgagcctcagtttc

SEQ ID NO: 59 - DNA, 201 bp, Homo sapiens
gatccaatttgtagcttcctgcctggcttcagagagcccagcaaccttctaggcctgctttccagacttctgagatagcctgggatgagcaatcctgttayagtacatctggaccttccctacctgggctctggggaggctgtgggcctggagagggaaaaggagggagggggtgtctgcaccacctgggaagatagcaca

SEQ ID NO: 60 - DNA, 201 bp, Homo sapiens
aagcacaggggactcaccctctttcatatcccttgccctgccctgaaatggacaatcactttttgggataggttgaaatttttaaagagcctgcatcattyggttccctcaaagggaagcccttgccagtgggggtttgaaagagaatttttggaaccaacattcaaattctgcctcatctggagggaaaccaaaattggg

SEQ ID NO: 61 - DNA, 201 bp, Homo sapiens
tttggatgcaatttcatctcttctgtacttaccacctgagcagcagactgatgaccttctgaggatgacagaatcctggttttcttctttatctcgggatycactggagctcttccgtggcattagtagtcagcccttccctgaactacactgtgctgccttaaaagtgtttacggccattgcaaaccaaccctgggctca

SEQ ID NO: 62 - DNA, 201 bp, Homo sapiens
acatgcgtgtgccagacaccgggcagtacactttggaaagaatgtgaaatccttttaatttttaatccatagcttactgcttgtgcagtcacctgcctctygaggttgctcattgcccttggacctgtgaggaggccctcagattagtaattggtgcttagtactatttatgcttaaatagatcttccactacaatgttga

SEQ ID NO: 63 - DNA, 201 bp, Homo sapiens
aagaatgtgaaatccttttaatttttaatccatagcttactgcttgtgcagtcacctgcctctcgaggttgctcattgcccttggacctgtgaggaggccytcagattagtaattggtgcttagtactatttatgcttaaatagatcttccactacaatgttgaagtcttttttatggataataacgtgtttgatggagta

SEQ ID NO: 64 - DNA, 201 bp, Homo sapiens
agcttcatacattacctcccttctcaaattcggtaagacagtagttttggggaacttttttgcccatgtgtcttttaagtgtgattttaaaaaaatgagtsgttcagttcattcccctaaacagaagaaaagaccaaataattaccttccattcctcttcatgtgggaatatagagagggttcatgtggcattttagagaa

SEQ ID NO: 65 - DNA, 201 bp, Homo sapiens; identical to SEQ ID NO: 62

SEQ ID NO: 66 - DNA, 201 bp, Homo sapiens; identical to SEQ ID NO: 63

SEQ ID NO: 67 - DNA, 201 bp, Homo sapiens; identical to SEQ ID NO: 64

SEQ ID NO: 68 - DNA, 201 bp, Homo sapiens; identical to SEQ ID NO: 62

SEQ ID NO: 69 - DNA, 201 bp, Homo sapiens; identical to SEQ ID NO: 63

SEQ ID NO: 70 - DNA, 201 bp, Homo sapiens; identical to SEQ ID NO: 64

SEQ ID NO: 71 - DNA, 201 bp, Homo sapiens
gcccatggccctggagcagaacctgtcagacctgcagctgcaggcagccgtggaagtggcgggggacctggaggtcgattgctaccgggcaccctgctccyagagccaggaggagctggccctgcagcacttcatgaaggagaagcttctggctgagctggaggggaagctgcgtgtgtttgagaacattgttgctgtcct

SEQ ID NO: 72 - DNA, 201 bp, Homo sapiens
cccgaggtggctgaggctggaattgggtgcccctttgcaggtgtcggctgctccttcaagggaagcccacagtctgtgcaagagcatgaggtcacctcccrgacctcccacctaaacctgctgttggggttcatgaaacagtggaaggcccggctgggctgtggcctggagtctgggcccatggccctggagcagaacctg

SEQ ID NO: 73 - DNA, 201 bp, Homo sapiens
gccaggactccacaaggctggtcccctgccctggagcaacttaaacaggccctctggccagcctggaaccctgagatggcctccagctcaggcagcagtcwtcgcccggcccctgatgagaatgagtttccctttgggtgccctcccaccgtctgccaggacccaaaggagcccagggctctctgctgtgcaggctgtctc

SEQ ID NO: 74 - DNA, 201 bp, Homo sapiens
gcggctgtacctgaatggagatggcactggaaagagaacccatctgtcgctcttcatcgtgatcatgagaggggagtatgatgcgctgctgccgtggcccytccggaacaaggtcaccttcatgctgctggaccagaacaaccgtgagcacgccattgacgccttccggcctgacctaagctcagcgtccttccagaggcc

SEQ ID NO: 75 - DNA, 201 bp, Homo sapiens
tgcactctggactcaagaaactcttagttcagtggaggaaatgagcagataagtagatcattatgattgagagtaggagaagcttagagaaagcacagaaycccagatccagctggtgaaggagggaaggcttcaggcctttaagctcagcctgagaatattgtgaaatgcagaggatggggaaaagggaagagtaccgac

SEQ ID NO: 76 - DNA, 201 bp, Homo sapiens
ttctccagggtcagaaacaggaccgggtggaagggatggggtgccagtttgaatgcagtctgtccaggctcgtcattggaggtgaacaagcaaacccagasggctccactaggacttcaaattgggggttggatttgaagacttttaagtttccttccagcccagaaagtctctcattctaggcctcctggcccaggtgag

SEQ ID NO: 77 - DNA, 201 bp, Homo sapiens
caaagagaatgataatggtgatgtccctgctttttacaacagatcatgttctgatatatatgcaaatctgtgtaaagtaaaccctacctaaaatgtactgkggacccaagatggactgcctgtattgcttccaggataaagtccaatttctagctctggtttttataaccttgcttcagctcaccttttccgtcatcatcc

SEQ ID NO: 78 - DNA, 151776 bp, Homo sapiens
caatttatttcttggagaaaatcttggggattacattaaaaatgaaaattttagttcccacattcttttttttttctgagatggagtctcgctctgtcacccaggctggagtgcagtggcgctatcttggctaactgcaacctccgcctcccaggttctagcgattctcctgcctcagcctccccagtagctgggattacaggtgcatgccaccacacccagctaatttttttatttttagtagagacggggtctcaccatgttggccaggctggtctcaaactcctggtctcaagtgatccgcccgcctcggcctcccaaattgttgagattacaggcttgagccaccatgcctggccagatggtttttatttttagcagagatgaagtcttgccatgttgcccaggctgtctcaaactcctgagctcaagcaatcctcccacctcagtctcccaaagtgctgggattacaggtgtggggcactgcacctggccatgaattttatttctatataaccttcaggaagattccagacattttagctcctggactcatggagctggagggagccctagttactagatctgattgttttataaaaagggaaactgataacacagagagggtgggggacttgccaggtcacatggccaattcattgccaaaccaggactaggactcaggcttccatgctccccaccttacccccatcaccttcacacccataccttgttccggaagggccacggcagcagcgcatcatactcccctctcatgatcacgatgaagagcgacagatgggttctctttccagtgccatctccattcaggtacagccgcaggcacaacttgtagccatacttggcagtgtagaaggctgaaacgcagaagccagaggcagttgggaagtgctggactttgcagatgtgggactgggatccagtggtcaggcatgcccaaggtcagcggctcaaaaccatgaaagatggggttagaacccagcattcttctcgagtagggtgtcagacaggaatgggctcttgggggtcatctagcttagtgtttgtcagctggccatccaagtcatacactgccgggccccaccctcagagtttctcactcagtgaccctggggtgagaactgagagttggcacttccagcaagtttgcaggggttgccaatgccactggtcctaggaccacactctgagaaccactgatctaaccaacctatgttttacagtctggaaaccaagctgagaaaaacaaagtggctggtcaccatctcacggtatgttggggacccagcaagaatgaggggccaggcttcctgcctcccagcagcagtttctttctgctgccctatgccaactggctggggtcccctggaggctgagggtacatggggtgactcacagttctgccctatgccaactggctggggtcccctggaggctgggggtacatggggtgactcgcagttctgccagccattctcaggtggcaaaaccctttgagggctgaatcatacctggtgaacatgcacagaaaccccctgggcagctaaaggggccatcccatgagagcatgtcctctggcagagcgcccttctgggagaggctgactggggacatgaattgggggcaggcaggaagagggtggaggagggacaggctggcagtctgactcatctttgcccattacgttttggtagaacaggaagcacgaggtactgcttgctttttccctctttgaaaagaattgagggaaaaaggtctacaagtagggctcgaggccaccccatgaagagagctgtcccaacacagtgggatgagcgctactcctgcaggaaaggagtcccagccctgctctgggattgtgacacactccgctgcctcgttaaaaaaaaattgttttttgagagggtcttgctttgttgcctggactggagttcagtggcaccatcatagctcactgcagactcaaactccttaagccatcctcccatctcagcctctcaagtagctaggaccacaggtgcaggccaccatgcctggctaatttaaaaaaaattttgtggagatgggatcttgttacgttgcccaggctggtcttgaactcctggcctcaaatgatcctcttgcctcagcctcccaaagtgttaggattatagacatgagccactgcacgcagtctgctgcctcattttttgcacaaatatatgcactgttatattaacagatatcatttagttaagagaaacacttgccaagtaattactttatgcaagacattgtgccaagcccaggggccccagaaatgagtaagaactgagtaagacactcattcacatatgctacctgcaatcatacacaagtgcatgtgtcttactcagttctctaatcttatttcagactgtcggctctctgaggccacggtgttcacttgtgaaaatcatcatccacatccatctcatctgcacatactgtggcccacagcacactttccttcacatcccaaacccatgaagtgggtaacagttttgattcctatttgcagaatgggactgacattcagggaggagaaagggcctgaatgtcagtcagctggggccaccgctatgtgtggctgagagccacagggcagagcacggttcacccaccaacctgaagatcccagcatggttcctgcccatggtgagtggcctgaatgggcactggcctaaactggacacagcgtgtctgtcacagagctggcagttttcactgcttgcttcctgggtcctgtggggcctgtttccccaggcaggtctctgtgcccctgggaggtgttacctggggagaagaggctgacggtcctgccacaggccgactcatggcaccgcctggtgacattggtgatcttccacaggaaagtgccatcgaaggaggcctcctccatgaggcgcaagctctgctccagcttgcccagggcctggtctttctgggccagggtctgctgaagctccaccacctgtagggaagactgttcagccaggaacaccagaacccggcttggggatgggatgggaatggcgggatgtggagattgatctgccccagatgtgttttgctgaccacgcctcactcaggtgtgcgtctgcatctgaatgtgctgccccctgcctggccttccttttccttatccaccaggaatccagctcatatggcccctcatctgggaagccttcaaccactgtcctagcttagctgctctctttcaatatgttcttacagagcccttacaatgatttcatgagacatatttttctggcttccctaccagatggtctcctccaccgaaagctgggcccatgctcattgtgtctttgtgtccatgccttgcatagtacctggtatgtaaaagtagagctgggaagtttgtgggtgaaatgaaggtataattgtggctttcagggaggctgccttttaactggagcaagagttacataaataaaggctaaagcctcagccactccaactcagcgcctggcccttctaatagctttccccaataaaatggaaagaatataaatttattcttgggtgtgctcaggtagggaagccatgaatggaagtgagcatccttaaagaaaatttaatcgttaattttactgatggggaaggtcctgagagggaaagtgacttgctcagacccacacggcaggtggctctgatcacctgctgtaatggtaattgcgaatggtgaggcagataatggtaatggtgaagcaggaactaaaatccaggcctaactcaatatgagacaatgatgtaatgttactgcaaaagaagcaacattagaatggtcattggctacattaagaaaagtataggccaggcgcggtggcttatgcctgtaatcccagcactttgggaggccgaggcaggtggatcacgaggtcaggagatcgagaccagcctgaccaacatggtgaaaccccatctctactaaaaatacaaaaaatttagctgggtgtggtggcacacgcctgtaatcccagctactcaggaagctgaggcaggagaatcgcttgaacctgggagtggaggttgcagtgagccaagatcacgccactgcactccagcctgggcgacagagcaatactctgtctcaaaggaaaaaaaaaaagaaagaaagaaaagaaaagtataagctctagaataagggagaagacagccctgttggaccaagaactgtggccaagtggattatctggagtcagcctggtaccatactccaagcgtacagaattctttggagactgagccagagcgtaggatggcaatgtgaagcagcatgctctgaggaagacgtgaaggcgctggggcttttagcctgaaaagggaagcactcaggtaggacagaatctgaccctccatccctgaagggctgtcatggggactagaaggtggatttgtcttgtgggctctgaggggcagggccaggaacaatgcagggaagagacaggctgattttagcttagtacaaggaagaacttgctaagagtggaatatgtcctgcactggaatgagctgctcagggaggtggtgtcttatcacaaaagttcaagcaaaggaaccgaagcactggatgggaggttatgaccttgactacagcttctaactcagcgctcttcctggaagggtgtgggataaaggggagatacgttttgatggagtgactgctgtaagcaggatgaatgattaggaggaagcctgtctgccgctctggagacaggatggggctcagccgggcttgaaggcaaacctgcctcccacactcaccctctgctccaagctcaggatgcgctcacggtccagctggctctggtggatagaggtggccagggccaggtgggaggcctccacctccttgttgaggacagcaacaatgttctcaaacacacgcagcttcccctccagctcagccagaagcttctccttcatgaagtgctgcagggccagctcctcctggctctcggagcagggtgcccggtagcaatcgacctccaggtcccccgccacttccacggctgcctgcagctgcaggtctgacaggttctgctccagggccatgggcccagactccaggccacagcccagccgggccttccactgtttcatgaaccccaacagcaggtttaggtgggaggtctgggaggtgacctcatgctcttgcacagactgtgggcttccctgacaagagagtggggctgatcagtgaaaacagaggtggagtgaggacaggggagcagtggagtgccctgctatcaaaggtcaccaaggattattcattcacccagcaaaaaggagtggctttctgtacagtgggagggattcagaggaagaccctggcatcagacatgcccacgatgagccacatgcattgcagcttctaattctgccctgccctggagtgcaaggatgattcaggaccatggagaggggcattgggggtgggggtcattttagtgatgttctgcctatgcttaggtaagacattaggaagaacttccctgagtactgtgatgacttaatagtaggctctgatgcttgggaaagtcattagtacaaaggacatccagatgagtggactgatgttacgggaaaatcatggaggggctgcagtggggagacctggaggtctggaaccatagtggatagatctcctttctcacactcagatgcttaccttgaaggagcagccgacacctgcaaaggggcacccaattccagcctcagccacctcggggtgagcctggaaataataatcacatcactgaatgttatagcgatccctgtggctaccctggggctctcttcaatgcaccaggatccaccagggcaggagatggcttgggccacatgactttgcacactgctgttccctttggctatctcctttccaccctttaagcttccacccttccatgaccttccttcaaaacaggacctgggcccttactgtgatcctgggcagcactgctatttctcctgtcagggcacagtccacacagctccgtaatcatcactcactctctggttgccccgactggtcgggggggctctgtgagggccatggctgtgttcccagtgctgagggcagtgcctggcacagctgagacactcagaacacactgactgcatgagtaaatgcctccctcctcctgaagttcatggggaatcttgggctcacaattcccatctgcatccctccttggccatctatccttgactgaggtgtgtccactccgcacaactttcccttccagataacatccagcctgagggaagggatacaggagggtctcagtgctattataatagcaatttgaccccactgttagcctatttaggtctgaagcatttaccaaatgctttcatggccataattcttcctagggctccttacagcatggtggggaagagagggtgggtttttattcctattttactgatgaaaaaactgaggctcacagaggggaagggatttgcccaaggaggccgagctgggaggcagcacagccacagggcccctcccacgcacatcactacctcttaacaggagtcagcccaggagagatgggaaaaaagtttttccaacatatacagtcatgcaacaggaatacattctgagaaatgtgtcatcattgtgtgaacatcataggatgtatttacacaaacctggatggtataccctgctacacaccgaaactctgtgacagcgtattgcccctaggctacaaacctgtacagcacgtgaccatactgaatactgtaggcaattgttaacactgtaagtacgtgtgtatctaaatatatctaaacatagaaaaggtacagtaagaatacagtactatactcttctgggaccatcgttgtatatgtggtctggtgttgactgctacatggcacatgactgtatcttcataaaggcttgtatccagaatatatagagaactcttacaacctaataagagacaaatgacctaataaaaaatgggcacagccaggctcagtggctcaacacctgtaagctcaacactttgggaggctgaggcaagaggattacttgaggccaggagttcaagacagcctgggcaacataatgagacctcatctctacttaaaaaaattttttaattagcagtcttggtggcgtacacctatagtcccagctacttgggaggctgaggtgggaggatcgcttgagcccaggggttcaaggctgcactgagctatgatcacatcactgtactccagcctgggtagcagagaaagaccttgtctctcttaaaaaaaataaatgaataatgaacagatacaatctatgaaagtatcttataaagttaaatcatacttataaaataatttacttataaaccatacttataaagttaccatacaatccacacatttcactcctaggaatttacctaagagaaagtaaaacatatgtctgcacaaaggtgtgtatgtgaatgttcatggcggctttgttcaaagcaacccaaatgtgtcatcagctggtgagtgggtaaacaaattggtctatatatactacagaacaaccaaatggaattaaataccagcataaataataacatggatgaacctcaaaaacattatgctaagtgaaagaagtcaaacaccaaagactacatactacctgtttccattcttacgagcttctagcaaaggcaaaactagagtgacaggaagtagatcagtggttgcctcctggagctgtgggtggggaggggactgactatgcagggacacaaagcagctttatcccgtgcagaaacatttgccatttgactgtagtggcggttacatgattatttatattcatcaaactgtacacttaaaatgagtgagttttatggcatataaataaaatcttgattctataagcgctttgttatttatttatttttttttgagagaataatctcatggaaccacgtgaaaggggatttggacgaaagcaggagaggacagaggtctttcggactgagcaaatacaaaaagtcacactagttattattctttaaaagtaacataaccagagagctgtgggcttaatgagtacagttgggttgagacacagaacacagcccagcaaaggccaccctgcccccacccccacccaccaactgcccagggcttcagggacaagttgttcccaataaataatagaaaacagatgttctatggaaggcaggcagagggcggccttggcagggagaccgtgctggcttcgggaagtctgtggtgatgaaacctccccaaacatgtagcttttgacatgtgagaacagtggagggaagatgctatgtgtagacctggctccttggtgaatatacctgggggagcctttcaggtcccacccctccccacaggtccatgattccaatagtctgtggttctaagggtcaaagcttggtgggagagtcataaaagagataagaacatgaaaatgatcaagctaagagtgaaattccagacatcaccccgcaggtggaggggatgtgtctttcagcagcggagctgtcctggcgttgtgtgaacagcaaatgtctgttttagggagtgaaatgctattcagatgtagggacatccttctgtgatgcgtgtacagatgtggactgtgatgagccttgaacagttgctggagaaaggggcaggggtgacttgagaggctttcagaggcttctccatcatcattattcattccttagagtgcacgggagttcaggatgtggcctctggagccagccttttggggttcagagcttgtttctgtcacttcacatactagctttgtggctctgggatagttactaactcctctgttctgcagtttcctcatctgcaaaatggggataataataatacccccttacagggttattgtgaggattaaatgagataatacatgtaagcactggtattagttacccattgctgctgtaacaaaataccacaaacttaacagcttaaaacaacacagctttattatcgtacagttctggaggccaggggtcctaacatggaaatgtcagcaggactgcgttgctcctggaggcccaaggggaggatggcttcctcccttccccagcttctcagggctgcctgcactccttggcttgtggtcccttcctccatcttcaaagccagcagtggagcatctccccttctctctgaccctcatctccctcttctgaggacacttgggcctcctggataatccaaggtcacctccccatctcagaatccttcatttaatcgtgtctgcagagtctgttttgccattgttatgggctcagcaacccccacccaaatcagatgttgaagtcctaaccaccagtatctcagaatatggagacagggcctttaaagagctaattaaattaaaatgaggtcattgggggtgggccctaatgcaatgtgactggtatccttttaggaaggggaaatttgaagaaggaccacatgaagacatagggaggggacagccatgtcaaggcaaagagagaggccttggaggaaaccaactcgccaataccgtgccttgaacttctggcctccagaactgcgaggaaatacatttctgttgtttacaccacccagtctgtgcactttgttatggcagccctggcaaatgcatagagccatgtgaggtcacatactcacaggtcctggggattcacatgtggacatctttggaggacattattctgcctaacacagtgttcaataaatatgagccattattactaataataaattaatagtaataatggctcatatttattgaaattattccatactactactgaatacttgttgaatactactgctactaataacactaataatactaatagtagtaatactactagtattactactaattagtattcttattcctgtggattaagcactgccccgggacatctcccagtcccaatccctcagtggctgtcatatacatgtatctcatttaatcctcacatcacaaactctttaacaatgaactctctaaaactccattttcccactggatttcctcaaggtggtgaggaacattcctaaatgaacaggaccaaaatatgtttgaatgttgtcccataggatccctgtgacaatcatctgaggcaggtggggctgtattagagtcaccttaacacaggcagaaacagagggaatggcttaaggtcatgctgagcttgtgagcagaggagctgggcacacctgtgcattctctctcacagttgtgagcccctgcatgggcttgctgctctcctggcactcatgtagacactgtcccatcagatcctcacagccatgagggggaggttggggctctgaggttctgcttccctcgggtaggtggagaagccgaagcccaggggcgatcagtgacttccaggaggcaacggggcaggcgaggggagcccaggagcctggagtccgtgtgcaggctccgtcctccccaccatagtgtccttgcctggggtggcctcactcaaaggccagggaccgaggggacaggagagggaatcaggaatcagactgcattgcaggagaagaacagaggatctgtcctgggccaaccctgtctggtgtcacaagtggcccctgtgtgagtggcctcactgcttgcaaattgctaaaaataaagtgtgcagtggaatttcctccgaggaggagacagaaacagagaaaacagattcccagccctgagggaacactcgttcttctgtctgggtctgaggagtctctgcgtgtgtggtgtttccggccaccctggctacccaggccctttgtggtggggtcacagtgggccctagcggggggccccattctgagacctggggcctccgggaatgtgactgttaagagggtgctgggagcatgagtgccacctctgcagcccctgcacagaacaaagaggatctgagcaggccaggcactgcctacccccacactgggctgaggtcagggatgcccggaggggctgctgtgactcaggtctcagctggtgctgagggggtgctctacagtcacatggggagcttggtcagtctgccactgtccgcccgttcctgccctcctctgtaactgggccggtttactctctgtcagcctctgctcagctcgaccgccacctcctccaggaagccctgcctgattctcctggttgaacatagtcttgcccattcctgtttttcccatagcacttggtggactcctgcactaaagcctgactgtgttatttaagcaggtatgaaacatttaggggaggattccttgtgtagaggcagcatagagaagatgccaccagctcaggagccatgggttagagcctggctttgcctcccacttgctgtgtgactttggtccaggcacacctcctcatggagcctcaaaatattacctattggtaaaatagggctatcaccgccacccaccacacaggatgtcacaggatcggggcgattacagatgaacactgtcaagctcagaagtgtaaggtttgggggtttattcccaggtatcacacttcaaggaacacagataaacagaagcgcatttaccccaaatgcacagagactggggaaagactgctcagtgtctttccatggaggcaggactgactccagggataggaggctaagttgccttttgtgacctcaagggagacagacagacttcagctcagtacaaagaaagaggagaatgttgcatcactcagagctccccagggtaggtgtggttgtttcatggagtaatgacctctctgccattggaaggacatggagccacgtagcatgaatccagtacagaacagaaattggactagacagcttaaacccttgtcactttctgagtctagacaaattaaggctttactgtgagctactggcatcagttgtcagcttgcttttgaccttcttgaatgggcctcagggggagggggtgggagaaacaatcccatttgctgatcctcagcagacaggactgaagattatctccagccccctggcatcccctccttcactgtcacttctacaggaagatcacgccaggcaagtatcaagtctctaactaggtcaacattaatcctctaatatctgcttcttacattaggtaatcagtccatggctctgggcacttctttgggagataatcatctaatgaagtcacaggctggggacaaactgataagcagatggcatgggaagtgtttgcaaggagggctggtcctcagccctccaccctgcctccatttcccaggttgccccagatgtgcaggcaaacttaggaattaccacacatgcaaagtggtgacttatcatcagccactttcctttggtcaaaagtcccccaaagttcccactggggcaaaagtcagaggagtccctggtccttcccctatgtggctttgtgtaggtgatcagaccatgacttaccgcccctccccaccccagcttttcaccagaagtccatgactccacgaggtggggaagccagcagggaggggagggggctgatgcctctcagaggtctgcccgcattaaagaaggcttctttgctcccaaatacaggcagcttcctctcccatcctgtagcctgttagggtgcctataattctaccatgaattatagtgccttcacttggcttaaggcagcaagtttcaaactgtgctctgcagggccctaggagtccccagaacctcttaggggctcggataggagaaagaaatggggcaattaacaggtcggggctccaggatccccctccatcagaatgcttttactttcatctgattgaaaaagatgaaaaaaagccattggattaggagatattaaaatatctatgtgatctaagatttacacaataaatgtgtattaattttgttaagaggaaagaataaaacaagctaaaaacaacagtcctagagcattcaagcaggtaagggccttttgcaagtgaggcatagtggctcacagagttgagggtctgcttgtgtctcacagccgatccaccaagagccaaacagtgaggctcagggagttactccacggagcagcatatcatattaactcttaccacgttgcagagtgtaaagttccaagaacatgcatttggtccttactcttactctctgagggcctgccgatggagaggttgctgagaagcagatgggagagtgctcaaaaccagctctgggtgggacaggaaattcccctgaactctctgaatgagagggaccagctcagagaaaggagaaggaggtgtggacactcgcctgcctctggtccagcggtagggggatagctgccctgccagcactgctatcacggtctggacatcacagatcctggaaaggccttgcagagctgacttaatatcctcattttacagatacagaaacagggcctgggaattgctgctagccaagcagagaattatgcagaaccacccctggacatcaggctcctgatccctgggccacagtttgctgcaagaagagggctttggctgaaaggagccaggcacttcccagtggaggtagagagggcggctgagcaacgagactcctctgcaggtctcagggccccgtgtgtaaacaagaggatttgattttgagcagtgactcctgcctgtttggattcgtggaccaatacgagtgtgtttttttttaaattgagagattaacaaagagattgtcatctttttaattttacttagcaaaggctttgccaaaaactatcatctacgattacatcctttcatttatataaagacatgcataggacagacgcaatctcagagtaaaagtttggttttataaatggaaagaatttagtttacataaactgatttatagaattgccttatttttatcattttgtcatgagctggtgggaatggatcagttctggatagcatgtgggaacctctgagcaggacatgtaacctatgagggtccttccagcttgggagggccagggttctaaattgtagctcctgaaaatgtctctctggcctatcacacttccaaatgtgtctcttattcctagaagcaccgtttgacagagctcaggacgtgagctgataatggtctctccccacctaaaggcaaacagaggcagacagaaccatctagatgaggagtttgctaaccttttttatgtaaaggggtggatagtaaatattttgggctatgaagtctttgttgcaagtactcaattttatataattttcatgtgtcccaaaatatctttttttgtttttttgagacagggtctcattctgctacccaggctggagtgtagtggcacgatcatggttcactgcagcctcgacctccccaggctcaggcgactctcctacctcagcctccagactaactgggactacaggcatgtgccaccatgccaggttagtttttatattttttgtaaacatgtggtttcatcatgttgcccaggctagtatcaaactcctgggctcaagctctccgcccacctcggcctcccaaagtgttagaattacaggcatgtaattctatgtaatttgaattctaacacttcagaattacaggcatgtttgtcatttaccaaggggtttatatttgttattataagaacttttttgattattattgattggggctcataacaattctgtgatgcagaaaacagttttacagacaagcaagctgtggcttgagaacattagcagtgcagcaggccacacagtgagagagtggcctcacagcctcgagaattacaggtcattatgcatggcctatcattcttctgattttttcaaccatttgaaaatataaaaaccactcttagctcgttgcttaggtggtgggccagaatgtggcccatgaaccgtagtttgtggacccctggtctggactgttctcactctaagtctattgccaggtagctttaggcaagacacttcaccactgtgaacatcagtctccttattccttataaagcaaattcagtctggactcaggactagttgggaggtgcctgccaggggtggagtgggcagctgtctacttggcttcaacctggaaaaatcaagacaacggacaaatgcctttctgtgatgtgccaacgtaccttctcctgagttcgaagacggcttcctgggcttatagactggaggtcttcccctctgcatttggggcagatctgatcctcgccattcctggggaaacatggacaaagccttggagagaggcactacagctccctgcaccatccactctcctgacagctccagaagcctcaactatcagcagggtggtgatcatgtacgtccacaatcccagagccacagttcctaaatcgcaaaactgccgagtatcccacattttttggtagtttgcagtgagcttcctgggctgccaaacctgccgtgactgcactgaccggaagctattatagcccttacttgccccacttagtgtgaatatatacatgtttcattgcagaaacattaatgtgcttgattacagggcactgccgcattccctgccacaattacatgatgccctgatttgcttttctaaaaaaaattctgaattacaaaacacatctgatctcaggggtttaggcaaaagattgctgacatgtgactatatttgctcttctcatttggtcctccatttggttttggtcttatatgtttagtaattacagaggatcatggcctattagaacaagaaagggcctcagagaacatctgtcctagaggttcttaatcaggaatgggtgtcagattctaatgggtaacacctgggtacccgtgggttttttgtctgttttttgggggtttttctttttttgagacagggtcttactctgtagcccaggctggagtgcagtggtgcgatctcagctcactgcaacctctgcctcccaggttcaagtgattctcatgccttagcctcccaagtagctgggattacaggtgcacaccaccacacccagctaattcttgtatttttagtagagatgaggtttcaccttgttggccaggctggtctcaaactcctgacctcaagtgatcctcctgcctcggcctgccaaagtgctgggattacaggcatgagccactgcgcctggccagcaactgtgtttttacaaagctcctggtgtctctgacctgctaccgctaccgagatagtctattttacaagtgagggaatgaggccccagagggcatgtggattggtcaaggtagagtgagtcaggagcagagctgagtagaagctcttcaggacttaggcctcaggcctcagccctccaacttccaatcagctccctcctctgccaggttttggaaggagggagaggggaaaccaggagacccactaccagagcctgagctgaaccctgacaatccgcttgatggtaaaaccagtgaacctctgctcctccacctcctggctggcctttccacggccacagcctctcctcgctattctcacagcctcctcctttgtcgtcatgtttgaacttctcacttgcctgattcagctttgccaccttcttaagctgtaaaaccgcaaacaaaaggtcatcacatgagatagtttaagggcatatttgccaggaaactgaccaaagctgacctaatctgttaggcctcagtgttctcatttgtaaaataggatcataatagtatccacccctctaagttgtgctgaggacccaagggcagagcatttggcacacagtaggtgcataattgcttaaagagggatgtccacaatagtactgatatcatgcctttctgggttgttaatattttaagtatcattaaatacacaaatatatatcgatctctttgtcccctccaaaagggttcccagcaaacggtctgaggtgatgagcaatgctgtggaaggagagatattcgtctaacagtttgtcattcaccaagaggtttatatttgttattataaggacttttgtgattattattcattgggcttcattaacaattctatgacacagaaaacagctttacagacaagcgagctgcggcttagggacattagcagagcaccagaccacacagtgagacagtggcctcacagcctcgaggctctcctcggtgtggatggctttcccctgtgggagctgatgcctttctgtggcttcctctccttccaccacagccagaggggcagtgtcagggagtgtgagaaaagggtgtggaaactgaggcccagagaagaaaagtcaccgcctgaagtcacaggctcctctgcccctcacctcccatcaggggtccctccctggcacccactttctgcccaccctccgctcctccatcacctcacctcgggttctcagagagacagcctgcacagcagagagccctgggctcctttgggtcctggcagacggtgggagggcacccaaagggaaactcattctcatcaggggccgggcgaggactgctgcctgagctggaggccatctcagggttccaggctggccagagggcctgtttaagttgctccagggcaggggaccagccttgtggagtcctggcctgggcctcactctctggtgagtaggagctctgatgactttatcttcttctctctggcttgtgtggttcaacgtcacagctgagtcacagcagggatggagcaggaattaccctttgtggcgataaaaatcccctggatggtgactgaaggctttaggagtgtccagtcatttttttttttttttagagtgagaaaaagcaagagagcaagtcagagaaaatgacccgtgtcacagactctcagaaagcacagtgagagttcccctggttgagaatcgcaggctgccgctggcttcccccacttccctgggcacatcggaggagggggccacagctggtccctggtctgtgttccctggcacctctgagcagcctggaattctcagtgggggtgctcaccttcctggtggaaatccccagggtgttggagacaggtccaaaatttcaagttctaggcgcttttgctctgctctgtttggagtgtctgggtgacctcaaggagaagtcacttcctcacagtgggttctgatgactccatctgtaaaaaagaagttgcaacaggtggcctctgggctgtaagattctgggaccctatcttgcctgggactgaggcaaccagaaggagcaggaaagccctgatgaaatccaaggcctaggaccacagactcctcagggccctccccacaccaccccactcaggaagtcataggtggctacatgctccggtcaggtgccaccactttactgcctcaaggagaacaaagcgctaaacaaatgcaagatcacagcagctggtctcagcatccaagtgggatgtagatccacatttgcaggaaaagtgcactggggaaacgatggctcccagaatgtgtactgtgtgctgggcaacagtttccctccaaatccttacagcaacctgcaaggaattcttctgcagctgtatatagggtcagagaagcaagatgcctggtccaaaggcacacagcctctggtagtggagtgggattcacaccagggctgtggggccccaagctctgtgtgcttgggatggagatcagagtacccagctcttgtctcatctatcaaatggagaagacaatccctacacatctttccatcctgcttggctgctacagaggttttgcaaactttcacagtggtttcagatcatgggttttgaggtcagacagagctgagttgaaatcctgggtccactgcttactaactgtgggccctgggacaaagtccttaacttccctgaaactcagattctgcatctgtaaaatgggacaataatacctatttcacccatttgttgtgatgactaaatgagatagtgggtcaaagtgtggtgtgtaacccaagtgaagtacttgaatgacatttggctcagatggtgactacaggccttccagctcctcagagaaaaggattaaagtggtgcattatgcttatactgtgctttcacgtctatctactggagcctcaacaggtgggcagggcaggtcatctggcctgagatacattaaactgcccacctgccctggtgtaacaccagggctgccacaggctggtggcaaagacagcacggcatcttaccgccacaatgtacatcaggacctccacccccataacaaacgacctccaggcctgcatcaagactatcagaagacactcccttttaactgtgtaccccatacctgcaagctttcctgcagccagccctacctgttccctccttcccctggtttgggataaaacaggcacccaagacttctctccccatctgtgggtcccttctctcccctccggcctcaataccaccctctctacctgctcattcccacggacatcaaaacgtgcgcaacctgctctaataagaaaagggaaaaatagtactacttttgggtaccgtcttacgtaattttacagacatcatctcatctaattttcactctgtgaagcaggtattgccatcatcatccccaccttacagatgagaaaactgaggcacagagaggctaagcgacttgttcaaggtctcacagctagtgagtggggacccctgaacccagagccagtcctgtaaccacgcacgcttttaaaacactctttattctcgtctccaatttctacatctactctcgcctcacctaacggtagaacttctagaaaagattgtctatacaggcacttggatctccagggaatcatctctccaagtgtatacgcatgtcggggacgccaaatgccctgggcccgccccagtttctatccaaccagccctcctgccagcacctgacccggctctcagcccttccttccggaatcccttcctttccccggcttcccgcatcctctgcggggaattccccccgcgtctctggtggctccttatccgtctccttgacccctttctcttctacactgggcctccatcggctccatccacgaggagtctctctgcgccgcgtgtccccatctcccactcgtcctttggggcgcccctgcaccagaccccactcccacgggaagtctccgtgggccgccccatgatgaggctgggcgccccgctctgtgattcctcgcgcctgccggcgccagcacagcccccgccgcccggctctgcaggctgagcccccagccaggtcggtgagcccgcccgagggcgggggagtgtcgcgtcgccacctccacatatccagttgcgagggcagcgctgggagccaggcagcgccggtgcccgcggaaagaggaatgagcccctgcggggccggggcgcccgcggctgggctgggggcagttgagtccggggcggtctctgcagccgaggtgccaggtccccggctgcacccgaggagtccccgcctcagcaagcgggagctggagcggggagttcggggcgaggaagggggccggggagccgccctgcggtcccggggcaggggtgtagggcagccaacctcggcgccgcctccgccaccgcctaccggcggccaggcccggagcttccggtggagtgtgaaggacgcagccgcaccggcggaaaccggcaaggcagggccggggcccggggctgctgctccccagaccgccgcggggcggggcgagcgatccctgtgaggggaaactgagtctgagggccgggtctgcggcgccacgggcactgtgcgcccagttaactgacacgcgtgtacgcagctcctccgcttgcggggctcctggcatctggtgcagcacctgcgcgtgtttagtgctcagtaagatgccccctgaaaaaacaaacacaaaccgggaattggagcccccaccctggtcccctgcctgcccaaaatccgagtagtgagaaggtgaagaggagtaaaaccgcagtcttacctttcttggatttctccagaagatcctagcacagtgccaggctcgcccaagcttattgggttggagcaatcaagtgatagtacttgatagtacttgatcaaaatgatagtactaagtggttcaaggcactgtgcttttacaaactggatattttaaggaaccgtttctgttttcgtctaaacacacacacacacggtcgctaaatccttaagaatatattaatcaaaatagttatggaacttagtgttggggtagaattttagattaaaagctacacctttatttttgcgaactaccaatttgacaagggctccttctctgtcagatgtcttaaccttgtaggactgatggtggagggagggatgaagctgcccaccttgttggtttggttttaacagctcaaaatctctttatgtgttagggtctttttttttttgagatggagtttggctcttgtcacccaggctggagtgcaatggcccaatcgcggctcactgcaacctctgcctcccgggttcaagtgattctcctgtttcagcctcctgagtagctgggcccaccaccacgcccacgaccacgcctggctaatttttgtatttttagtagagacgggggtctcaccacgttggctaggctgatctcgatctcctgacttcaggtgatcctcccacctcggcctcccaaagtgctgggattacaggcatgagccaccgcgcctggcctagggtccctttttatgtcctgactctcaactggattgtaagagcagggaacgatcttttacttgttttttaacctggcatgcctgtaagactctcacttattggaggcagagctgctgtcctccaacttccgctagacaggcggaagctgcggaacacagggtactctagtgaaagggggacctcagaggcccacctgggagggagatgctgcttgtggacaagcagaagatctcaggggcctctaagagagaatttctgcaatctatgggcaggggcctctaagagagaatttctgcaatctacgggaggttgcccagatgtagcctctgtggggccattcaattctacgggaaaaggattcaaagagttaagtgtttgaattaaaaattgatggactcggccgggcgcgatggctcacgcctgtaatcccagcactttgggaggccgaggcgggcggatcacaaggtcagaaaatcgagaccatcctggctaacacggtgaaaccccatctctactaaaaatacaaaaaattagccgggcgtggtggcgggcgcctgtagtcccagctactcgggaggctgaggcaggagaagggcgtgaacccgggaggcggagcttgcagtgagctgagatcgctccactgcactccagcctgggagagagtgcgagactccatctagaaaaataataataataataaaataataaataaataaataaaaattgatggactctgagtcaattagtctgatagttttcccatcatcagaaaacatttaattatctttgaccttgccttttcctgggtgttgtgaagttagaaataacattccagcaaaaatttgggaagaaatctggggttatttgttgaagggagtttctaagtctagtgattttccctaactcaatagatttccagattttaagaaaagaaacaaagcacctctgaagttatttgaattctaggcaccaagcaatccctggggtttttctagttgtttatgggactggccactttgaaggcgcaatggggatttcaatttctgatggaagtgccagtgacactcatggtcaggtgatgtggttcaggggaagagcttggcagatggatcagggacatgctctaagatgccagtgatgaggaagacattgatactagccagctcactgcctctctttgtcatctgtagctacccatgtgtcctgttctaacagactggtttttctgtgtggcaattcttcctttcatggactctggaaacaaagactcttccaaaggtgggcacactgcacaagggccttttgaagaaaagtttctcaaggatttggggcctataaaagccattctcttctgtcccacccaccccttcctctctgccctaagccagtgtaagtgaaaagagcaggcagtctgacctcactctcttcatgtgccacatcctgttttcagattaatgagctcatttgctggaaatttaccaagggaaatagtttaattttggaaagtaccaaaaacttatctgtagtcattcagcttcatttggggggctcttgaaatggaggggcatcaccggaggacctctgaacgcccagggagcagcaaggcaacagaaattgaaagcgagcccagtgaggctgaacctgactcagaaaggaaacaaaatcttttggaggccactcatgtctacccagttgaatttttttttttctaaaaataactttaaaaagagaaatagtttatctggccaaagcctcatatctggtggtctgaccatggagccatgactgaggaacaagaaaatgaacacagggaagcaggcagtgtttgagcctccaccctctaccttcttgtccatgtattaatatgtttggcttgttctaagaggcacggaaaggctttcagtctccagttttgccccaatcccttagcaatccgacccttgacattgaagttgtctgcctaacctagtagcctttgtggctcctgcagccagggggattctagatgatcacagatttgcaagccattctgcattggagatgatgagatgatggagcacaagtgatgtgcaccctagactttgcctctaagcatccaaccacctcctggcctgcactgtttcccagagtagagatttatcatccattctaagcagaatgaatggaacacgtaagtgaatccagccggctaaaggcagccatttgggcaggctcctgtttgtcaacagcccttaaaatgtggagcccagaatggttctcactccctcaaccccagtcagccctttggtgccttcttcttattaccagcagcacgccttgtctctgtcatacggcttgtgttcagtaaaaacaattagtgaacagcttttctgttagcatcattttaatctgctctgataacttctgattcttgaaccaagaaatttaattaaacagatgattacaagctgtcagcaacctatcagattagaagaccaaatggtactgggttcttcaatccaaattcagtatgtccctttggcacattacacagaactgatatcaacaacaaaacaaagaaataaaacatgatcttataaaaatgacagcataacacgtgtactttttgctatggtctgattattaaaaatgtcccaaatttccttctgttaatctccatcttggttcttattacacttataataactagcatttttaaaaacgtgcctgtttacaggtttttttctttctaccacagaattatgaatacacgaaattgtaggaatatatgaaaatgtgtataggaatatatgaaattagatgaattaaaaccatgaaagtaaagctgtatctgatttcattgttgtttcccctggcttagcatgatgctagttacataggagacatcactaaatatttattcaataaatgactaatatgcaagatgctattaatacaaattttacttatggtaacaatagttaatgatgatttccccaccatcagaaaacatttattaagtatcttcaacctggccttttcctgtgtgttgtgaagttagaaatagcattctaggaaaaatttggaaagaaatctggggttgtttgttgaagggagtttctatgtccagtgattttctctatcccaagagatttccagattttaagaaaagaaacaaagaacctctgaagttatttgaattgtaggcaccaagcagtccctggggttttactaattggttgtgcactttgaaggcgcaatggggatttcagtttctgatggaagtgccaatgacactcgtggtcaggtaatgtggttcaggggaagagcttagcagagggaccctttgatagggacatgctctaagatgccaatgatgaggaagacattgatactagccagcctactgcctttctttgccatctctggctacctatgcgtcctgttctaagagactggttttgctgtgtgacaattccttctttcatggactctggaaacaaagacactcctaaaggtggacatgctgccccagggcctttttccgggctacggaattattgctctttcttcacactcacctttgggaggcttgggttccctggccactggctagtacagcacaagaataacgcagtgttcgaactcaacagctgttaacatctggctgaggaaggatacagtatgaaggttcccatctcactctatcttgaggactcagcctgagagagaaaaatcaaggagtggggaaagctgttactcagaaatcagaagatttgctttgatgttggaggactgtggcggaaagttcctcccatccttgaaccttatttttcttacctgcaaagtgggagaatgacttcaggggaatccttcagcatgaaccatttaattctttaaactttaatcattcaagccctggtcctggggaagaggcacattctcccatctgttgaggggctgttctccccacctgtacttggggtggtaccaggaacccctataacgggtgctggaagcttccactagaggcatggtctttttggactccaaacattttgtgcgttttttttttttaagggaagctatgtgaaaaacctcctctgatggatttctttcagagctcaagccaggcaaattcccagcacaagccaaggcttgggagcaagaatatgtagcaggagcaagaggctaagaaccagggtgcagctctcactctctcaaagaatgcacaagctgggggtcgggagggttgtgaaagtggagttgatgtttgctcatctcttctgaactccttgtcttacaaaaggggaaatgggggcccagagagagaaatgaacttgcacagtcagtccaaggtccagaagcctcttcctctgtattctgatgccctattgtctcaagacatcttagtaataactctgtccttttattcctgcattcgtttctccttggatatgtctccacaagactgagtttcctgagggccaagaagcagggcacagacatctctgtaggctcctttgtgcctagcctgcatcttgtacacagtgggggcccagtaatgatatattaagagggacttctttgccttcataagaggattctgggatactaggaaatattaaccctacctttcacacctgtgggttacccagatgtatttaacaaatatgtgtttagcttctaccattagcctttttgcaatttttttttgtttgagatagagtctcactcctttatccagtgttgtgatcatggctcactgtagcctccacctcctgggctcaagtgatcctcccaccacaccctcccaagcaactgggactacaggcatgcaccaccacgcctggctaattaaaaacaaatttttttttttttttagaaacagggtctcactatgttacccaggctggtctcaaactcctgggctttagtgatcctcctgctttggcctcccaaagtgctgggattataggcatgagcctacaatctttttgtaaattttaaaaataattctagcatatatatctagcaacactttctggagatcattgtcttaatcatttcagatgtgcacttgtaacattttaaaatgcaaaatcaaatagataagaaaagccattctgtctactgccatccttggttactatcttctgtaaccagtgcccagctgcacagccagagagctgtgggtagggcccatggctctctctggcccctgtgattgctgaaactggaactgcttggggagccctggggccctggcaccagctcctgctcagtcctgcttctcctttcacagggaacatgtctacacaccagctctcctgagcagtcttggaacccctccaaggacagccctggacactggccaagggggagggtgcccctgggaaggacgtatctatcaggaagcagagactgtggcaggcaggcatacacacgcacatgctcgcaggatggctggcttacccaagatttcaaaagaagttggaaatctggatttttatgtgaaacgacttgatttttagaacaccctataagccaaaaaataaacccaaaccaaatgagcatccctatgaactgtgtctgtgggccactatttgtgacctctggtagagcctggcactccataaacacaacaaaagcagatgtgtgaacgtgcccacatgtaactcacccgggctgttcacattgttcatccagatgtggaccctgcacacacataatagagaccttcattggacattgacacacacatagtatctcccgggatgtggttttaatatttgcactttccacctaaggagactgaatgtcagaaagatctctaagatcatgtcaaaatctaggctgcctgaccacaaagccagtgttctgaaccgctgcacaaaccaccacccagatgcctgcactctgaattaaaattgccagttactttgcatccttctctaaactaagctttatgaatttagagactgtgtttcatttgctggtgcatcccatcacctggcactatgcccagcagagcacagaaggtgctcaatacgtactggtgggattgtacccacaggctcatacaaacgtgtacagacagggcacatgtaaacccacatagccccaccatgctgaagaacacatgcacactgacgttcccacatgcacaccacccacctccatctcccacccgccagggcattggaccctaagctggggcagcccaagtttcccctgccagccccctgccagccttgcccaaagccttcagaaatagtttcctggaaatctcgaggcggctgtggtgttctttttcctaactcaggagacaactcagcagttttgtttttcaaagtctgagactcataaacctggaatcctttcttcattttttccaccagaattttccttggcctgttgccttcccccagggccttggctaggaggttacactcggagcgccctctgccgggcactgtcctcccaaccttgtgggcagttgcagatgggacctgccccaggctgctttacagatgggaacctaagtcagatggtggtagtgaggagaggttagaggatactggcccattgcaagtgtgtgccagtgttattactagcaagggatcttttgtgatttttttttacgtttttgaaaataaaagaataaatagcttcaagagctcagatgaaggccctctgctctcccaagggcctctgtgtggggcagatgacagaggtttgggaaaatcacctcattcaactttattcttgggtctccatcacatttaataagtgaggaaatggagacacagagagattttgggggaagaggtgcgaggaatatttattgaatggctgctatgtgcaaggtatacttatgaatctctgtcatttcatcttggcaaataaacctgtagggtagttgcttttgtttccattttacagattaagacatagaggctcagtgaggtctctcaaggtcagaaagggaaggggaagagctaggatttgaatccaaatcttctttttcttggcttcgtagcctcctggattttttccatttggctgcaggtctgagttcagtggggcccagggtggagcctttgtggctggactcatcagaggccagggttccttggcctggctgcccagaaaggcaagcctttctccttgtacactaccagagagcaatctttgggggacacagtctttaggggacacaggggaatgggtcaagcagccccaccaggactcagagctgggaataggctcctgggactggcagctgtgccaaggccccttaacagtaaaaaacaggatcaaatgcctttatcaaccaaacgcatgagaggctccaaagggcagggttttttctgggaaagaaagcaggtcctgaaaggtttttgttttgtttttcttcttaatgggaccctacatttcaccaagagttagtcactaccctccctaatccatcctccatcctgcagcgctgtccagaaactttcaaaatgtctcagttcctgcaggaaaacatccaaaccctttatcttgtttgtttttggtctggcttggccttatcttccacttgtctcatataagcaaactgcttaagggtctctgtctgcacctcccttgagtcccactgctgggtgtttgcttacattacttctcctctcagaaataacttcatttcagtgtatccaaaccttagtcattcttccagacccagcttagaggccatcttctccatggagccttctccactgcatgcagcagaaatgaacctgccttgtacttgtctcatgggcacatgttgtagttcccctaatagactgaatcccttaagaaacagtgttggattcatcttggattctcctatatgggtatgagtgtgtgtgtgtgtgtgtgtgtgtgtgtgtgtgtgtgtgtatgcatgcacataataatgtcaatggtagtttgagaaggggaaacatggtgagctttgtctcatgatagcatataccagccacccaagaaatcttaacaatgagatatgggcaccattttagacaaacaagacaaaggagaggtggctctgctcagatcagcctcaattcctaaagttggtgtgggcaaagaacgctgttcccatggactagaagcaggccatgcacaaggaagctgatgtgaaaggcctcttagttttgtccagtgggggagggtgacaaactgaacacattgctggattcctacggcggcagaaggagtgaacgatgggatacagtgtggtgcaatgaacgtggaatggtgaaaggtctttagagactgggggagtggcccagcacagtggctcacacttgtaatcccagcactttgggaggccaaaacgggtggatcacttgaggtcaggagttcaagatcagcctggccaacatggtgaaaccccatctctactaaaaatacaaaaattatcctggcatggtggtgcacgcctgtaatcccagctactcaggatgctgaggcataagaatcacttgaacctgggaggtgaaggttgcagtgagccaagatcatgccattgcactctagcctgggtgacagagcaagacttcttctcaaaaataaaaagagagagagagattgggggagtgtctaaaaagcccatggacatgcccatgaaagagtccgagtctgctttaaagcccttgaaagccatcttatggcagtactggtcaagtaagctcttctgctcccctttcttctacctttcctccctaccaatccctctagtgctggagaggtcagaagtcacagcttgcacagcaatgtgaatatactcaacactactgaactgtgcacttgggagtagttaagatggtaaatcttatgttacgcattttaaatttattacaatcttaaagaaagaagcagccacactaaacagccttagtaagctgagaaggaaactccagggaaagaagcagctgcccgtgacactattcccagctataggggtcccaaacctgcagcaagccctgtttgggagagaagattgtattttaaatcaagttgagaattttgcttttgtatgggactgaacatcaaatttatgaatagagttgtttggtgactgaagtgatcataggactttttagttcctaagagtgatcacaacagtcataagatgcttgagttttccttaaaggatagagaaaggatatctctcccttccctttgaataaatctttatagggagctggaaggcaaaacaaagttgacttatgagtatgcacagggagtcctacttacttaatttagcaattatatttgcttttgtaaaatgggatctctccttccattatatttttctaattggtgttgtttgcctctatcacatcttccaaagcaactaaaagcttgggcttacctcagataaaggcacttaaccattacctgaaagatcagctgtgcttcaggctttaaacccttaattgctcggtattctcatgttcacaggttgagggactcagtattaacgtgcctttgttgcaagttcttgtaaacaaagacagtaaaattatggttctgatgttctattaattgtcattaatttatacctaccaagtgtcaggtcttgtgcttaggatacagagaagaacaagatacagcccctgtccgccaggagctcacagtgggatagaaggccatgataagaaatcaatgagaaggctgtgggtggcaggagctccagcacagatgtgtttccagagaaggacttacaggggcttgtcctgagtgtacccttgatgctggcactatgtctggcccatgataagcttcctgtcccaggccatgtgcttccaggaagttatccttgcttaattctatgtctactccgattacttctttactttatcatctcagcactttgcaattcagccttgtgttcatttaccctggtgctgcaaatacagggaacacacataatgcacaggatactgacatgctgtgtatctcagggcactcagaagagctgaagctatgatttgaatccataaagtttgacatctgcttcccattcgtaggcagttattacaaagtggcaatcactgcctttgtgatgatcataagcatttttcatgctcctacctagtctttaaaatgattctttttagaggctgcataatatttcatggaatatgcattctgtcatttacatgtaattatgagtaataattacaatttccccctttcgaactattaatttatatgtcaggttttttatatcacacaaagtacttcaataaattacagtggtattgctttatataccataattctagattcatagtaattctaggctaattcctacttgatatctccacaagaatgtctaaaaggcttcttaaacataacaaagccctgacagaaatccttcttctcttctgtatttgcttgtgagcactgggtaacaaagtgccacaaactgggtggcttgaaacaacagagatgtattctcacacggggctggaggttagaagtctgaaagcagtttcggcagggttggtttcttctggccggctctgagggcggacccgtcccgtgcctctctcctggcttcaggtgacagcagtggttctttgccttccttggtttgtacatgcattactccaatttctacctctgtctgcatgcgaccgtcctctcccagtgtctgcatcttcacgtgaggttttctctgcgtatccctgtgtctacatttccctcttctcataaggacacctgtcattttagattaagagccaccctattccagtgtgacttcatcttaccttagctaattacacatgcaacaaacttatttccaaatcaggtcctactctgaggtactgtagatttgaatttcaacatatctttttgagtgacgtagtgttcaacccataacatcttctttccttgttttcctaaatgtgtaccttctcctgtcttctccagctgtgtaaatggcatctgcagcagtgcaagccaggaatccgtgagtaatccttgactcctctgcattcattaccccaccctgattccttcagcaaatcctctcagcaccacttccaaaactatcctgaattcatccctgtctcttcatctccatttcttcctttctagttgaagctactgttacctgtcacatgacaatggcaccagctcctcactggtctcccctgactctgttctcatctacaacctggtctcatgcccttttgcttaatactctcaactgcatagaatccaaacatctcaccagttcttacaaaatcccagtgatctggcccctctcacttctctgacctcattgtccatcacttgctttcttcgatccagccacgtcagccttctcgctgttccctggacccctgggtctttacacgcaccagcctggaccttcatgtggttgttccttcttgtcaagaaaatctcagcttaaatgccaccttatttagtgatatttgatagaccttccctaaccatgcaatctagagcagccactgagtcattctatatcatagaacttttaaaaaattctctgcagaggccaggcgcgatggctgacacctgtaatcccatcactttgggaagccgaggcaggcagatcacttgagttgagagtttgagaccagcctgggcaacatggtgaaaccctgtctctactaaaagaagaaaaattagctgggcatggtggtgcgcacctgtagtcccagctactcaggtggccgaggcaggagaattacttgaacctgggaggcggagattgcagtaagtcaagatcataccactgcactccagcctgggcaacagagtgagactctacctcaaaaagaaaaaaaaaaattcctctgcagagaatttagtaaatatattattttccctctttaagtgggtatttattgtctttttcctcaattataacataatctccaggagagcagggactttgtttatcttgattacaccatctagaactgtgcctggcatgcaggaggcactcaataaatatttattaaatgaataatcttccacagaagatctttgtgtaccaactatttttttttccttttgggaatttatataaatcattcaacaggagaaggattactggatcaagaaatataaacatattttggctcctgaaatgcattgtcgaattgctttgcagacagataagatcagttttcatttgttgggcaaattttcaaatcccaagtgccaagacagtgatttctggtatgtgggagaggggggaggggaagggagaaaggaaggagggaggtggcggagggcaggcataggccgaatcagagctgctgtccctggtgggtcaatggaactagaagcagcagcagtagtaatcaaccaagcaggcccaccctccacagcgtctcaaaggcccacgcagggcaggaaagatctgctgtatgaacttgggtctggccacaggagccagagtgagcagaaaagctgacaggagcacctgctcttcggcttgctgttgaaatcctgaaggctgggtcaggggccaatgagcaagtgggagtgaggacacaaagtgaggcttggatctggtactgaaggctcctttgcagaggctgtttctgggttgcagctactctgcttaggacacgggatctggaacattaagttacacaaggacctctgtccataaacctccaggaacacagaggcctcttcacgtagttctgctgctgccaggcccattcagcagcatgctggccctgtattcctttgcttcctgctccgccactagagcaatggcataatttttaaaaagtgaaataacatgaataacatttgctaggaacattacaaaaaaggtgaagttaaaaaaaagaatccctaagaactaatacatagaagctgagaataaattaatcagactaaggtaccagttgagtaatccttatccaaaatgcttggaaccagaagtgtttcagatttcagatttttttcagattttggaatatttgcatatacatacaataagatatcttggggatgggaccatgtctaaatacaaaattcatttatgtttcatgtataccttatatacatcccctaaaggtaattttatacaatgttttaaacaatgttttacatgaaacaaagtttgtgttaagtacttatgtgtggaatttttcatttgtggtgtcatgttggtactcaaaaagtttcaaattttgaagcatttcagattttggattttcagatttgggatgctcaacctgtaattataaaattatggtaattagaagaaaaaaagaaaaattattaaaaccgtacaaaagttaacaggatgacccatcccagacctatagaatgagaacctgcactttcacaagctcttaaacaacacttctgaaactttaacatgcctataatattcctggattttttttttttttttttttgagatggagtctcactctgtcacccaggctggagtgcagaggcgcaatctcggctcactgcaagcttcacctcccgggttcacgccattctcctgcctcagcctcccgagtagctgggactataggcacccgccaccacgcccggctatttttttgtatttttagtagagacgtggtttcaccgagttagcaagaatggactcgatctcctgacctcgtgatccacctgcctcggcctcccaaagtgctgggattacaggcgtgagccaccacgccaggcctggatatcttattaaaatatagatctccgagctctgctcccaagattttctgtttcagtaggtctggggtggggtctgggaatttgcattcctgacaaactcccaggcggccagggaccacactttgtatagcattgttctaaggctgacagtcctgaggaccaaaagaggaaggcaaatgggaaaattcgaggcactggaggaggttgttttttaagatagtggtcttttcccaatttttaaaaaagcacaccaggcagtctctgtctatggtatcttagcacaaagatgctttttgtttttaatgctatgtttatatttgtgcaagattctacattttaaaatttctctcacttgttggatcttatttcatccttgcaacaaatctgtaaattgggttgggggaaattctttcattatttttaaaagatagaactgaggcctagagagttaagacagctggaaatcacactccagctgactgccacagattgtgggctcctgagttggcactaaggtgtttttcctaatcattataacccattagggctgataatgttacttccgctttctagatgggcaaattgagacttgatgaggttcaggaactctcccaaggccacaagtcagggcagctcctctgtttcatggttcaatgtcttacttcttcactgtatcacttccccatactaactcctcctttctctctctgtctgtcagtcacacacacacaacatagccaaatcagtgagccattttaatttcgacacccagcatttatttaatgaacagaccacagtttggcctttcgcctttagaggtgaaaggaggaggcaagaagaggatgaatgacgaccagccttgccccaaggccctaacagactcaggaaacctttctgccttctcctccaactctaagcatatctcctttcccttcctcttcctttgccctcagagaattacagtctagtcctggctctaatttcctaaaggttctttatttggaaaatatattattaagccaaacaatcctttccttaactccaatttctcttgtctcattcagtttcaacccccctcccaccgaccacccttccaacaccaacacacacacacacacacacacacacacccctccagcctaacaacaacaacaccaaaaccctctgattgctcccaactcatctgttagacatgttagccctggccctcaccaccaggctcgggtctctgcttgcccctgcaggcaatgtttctattaggccctgaggagacaccaggctgcatataggaaggcagaggagcctggtgctgcgggttctagccccagctctgttgtggaaccctcttggtgagtcctggctcctccctgggcctgcttcctggtctgtgaaatggggaggcattgatgagatgatctctagaggatctttaaatgtcaatattttatgaatctaagtaggatgttcacaggtaaaaaattattgaatttaccacctctagtgtgccagagaggtattattacccagccacaagttacttttattgtgccaggcactgtgctaatcattttatgtgcattatctgtattatctcatttgagccttgcagaaatcctctgacttgggtattattagtacttctgtttttcagatgtgaaaacttcacctttttattaaagcagtcaagtagatgttttcttgactattaaaagtctctcagcactgaagggacattaagccccctaccttgaattgcccagaaacatccctggaaggtggcagctagactctgctcagatggccccagcaataaggaacttggacctgactctacttttgaatggctatggctataagaaaatgcttcttcacagggagccaaaactggtgtctctgtaactcctgctcatctcagtggtgggaagaatgcggtgttcagaggcctcacttgggcttctgtcctggcctttccatttatcagcaccataatcctagacaagctgctcctctggacctccatgttcacaggcaaaaaatgaaggaatcggatgagatgagctctaggtcctttctggtgtgggcattttagatttgtataattcatgactgtgcatgtaacatacacatatctgactataatgatggaaacagagaaggagtggaattttggtggcggggggcctctgtcaggtatgaggctgtgagcatggtgtgtgtatgtgcatgtttctgggacaggggtctgtgaaagagaagagtggccctggacaactggcgtgaggcctcggtgtccctgggagccagtctggtgcccagagccaggctggggtgttctctgtgtctgatgtcatagaacatcaacatcagacaaaatggatccatactaaaaacgactactctataatcatgtttgagcaggatataaaaacaagaacattgtccaaaccacaaaaatgaccacacacacccttttcctggctaaagtgagtaagtgctgctacttttcctcccagctagaaaagaaataagatactgggtcataggattgcccctgcttcctgaaagcatccaatccagagtaaagttccatttctttgaggctcctcccaaatactctatcacaagtacaaatcctataataaggcttttctaatgcactctcaccgagaagccttatggtccccatggtgtgtgttctcccttgttgcaaagactcaataaactgaaacttgttcagttccaggtattcctggttgtcttgattggagggaattgataagtctatagctttcattagattctgaaaaggatgtgtatgtggctggagaaaatcccacaacccatgctgatcagtcccactttaaattcatgactagaaacttcaagtggacccttaatacgaagaagcaaatatattacaagtccttagttggttcagcctccctctcttttagataactgtctcacccttctttcctcccgtcacacctccaattgctcctccctatcctccatctcaggtgatgatcttcatcctacttctctgagaaagggacttccacagactctcaccacatctaccccttgccagcgtctgctgcatgtgctcagcttctctgcctacaaccatgggtcatggatcagggatcggtatgctgctgcccaagggctaaatccagcctgcctagtccatgcccattcttttctgcattatctatggctgcatttgtgctacaatgagagagttgagcagttgcaatagagacttatgagaattatggcccacaaagcctaaaatattacagttattttaatgcatggctctttacagaagtttgctgacccctggcataggtgagctagtcatgttcttatttaaagccaagtcctccacttgtgctccagatcctatccactcttacctcttcaaggacattactctagtagttctcctttctctctcctgcatcgtcaattatttactctttactgagtcattccctttagaacacaaatgtgttatttcttccgtcttaaactttccttcactctactcccctcaatccatttctttgctccttgaatgagttgtccatactccctgtctccaaatcctctcctcctatctactcttaaatcactctattcaggctattcttcccactactccacccaacctgccctgtcaaagtcaccaatgctaaacccaacagccaagtcttcatcttacttctctctgaagcatttgatacagttcaacactcttcctcccagaacctctttcttttgtttggcttgaggggacctcatctcttgttttttctcctaattcaatggatcctctatctcttttctctaataacttcatcttggaatgctcaaaatgtctatccttggtcttctttttttccactcctctgtctgtattcacatccttagtgatcttaactagtctaatggttttagtatgctgatgattctcagatttatgtttttcagcccagagctctctcctgaactagataactatatgaccaattgccttccaggctccttcacttggatgtttaatagatttcttctaaaattcaacacatccaaaactgaacagattcctaactccccacaacctgctccatctgcagccttcctaatctcaggcaactccatctttccagttgttcaggccaaaagtcttggcatcatccttgactcctttctttctctcacacttatttccactctatcagggaattcagttaaacctacaatattagtcccttcaattaagcctactgtattagtcccttttgtattgctataaaggaatacctgaggctgcataatttataaagaaaagagatttgtttggcgcacggttctgcaggctatacgggaagcatggtgccagcatctgcttctggtgaggcctcaggaagcttacagtcatggtagaagggaaaaaagagcctaagtggcacatggtgagagaggaagcaaccagctagaaggaggtgccaggctctttataaacaatcagatctcgtggtaactcacagagtaagaactctcattaccatggggagggcaccaagccattcacgagggatccactcccatggcccaaacatcttccacctcgcctcacttccaacactggggatcacatttcaacatgtgattttgggggacaaatatccaaactgtatcatttacttttaaagtatatccagaattcaaccacttttcaatacctccactgctaccactctggtctgaggcaccatcatccctcacctagtttattacagtagcctcctatccgttctctttacccttgccttattttcaacagcagttacagtagtcctttaaaaaggcaagacagaccatgtcactcttcttttcaaagccttgcaatggctcctgtttccttccaagtaaagccaaagcctcttccattggcttcataatctgcacctgccacccctgcttccttgcttttcctgtgacacaccagcatgctcctgccttaggccggacactatgtaccaagagtgccaggaacactctccccttggctagctatgtggctcactctttcacatccttcaagtctttgctcaaatttcaccttctcattgaagcccaccctgacctggccaccctatttagaactgcaacccctcccctgaccattaccagtctcctttagtctgctttttctttttcccattgctcttatcactttctgagatccaagactaattgcttaattattctctttattttttattacatatctctcccagttggaatctatgttccacaatggcagggatcttggtaccaagcacctagaattgggcctagcctgcagtcaccaatcaatacatgtttgttgggtgttgctgaatacatcagcatcatagggtctggaaagaaagactaaacatgactttggtccagaatttctcactgagaaatatggagcaaggctgcttgcctcaaccttggctcacagacctccacgtgttttcttaagacagagtatcttaaacgtcaatcatttgcatgccaactgcatgatttttgccctaagaataaacttacttttatttactcaatactttttcttaaatagacttacttcttggaaaatagatttattttggaagaaaatgttacatcatggctttgatgtgctaattacttttttaaaatacatgttaaaataaacatatagccactaaagtgaacaatgtgcatcgtatcacctaagaacatcttgcttacccctggggaaacctgccttaagcgttgccccttaaccagaaaggccttccctgtacctcccacctacccaaatcccagtgtccttctacagaaagccttggcagctcttccagcttacttctctgcactgtctccatacttacagacaaaatatgtaagcccaggccggccatagtggctcacgcctgtaatcccggcactttgggaggccaagggaggtagatcacctgaggtcaggcgttcgagaccagcctgaccaacatggcgaaaacctatctgtactaaatacaaaaaattagctgggtgtggtggcacatgtctgtaatcctagctacttggaaggctgaggcaggagaattgcttgaacccgggaggcggaggttgcagtgagccgagattgcgccattgcactccagcctgggcaacaagagcaaaactgtgtctcaaaaaaaaaaaaaaaaaaaaaagagagaaagaaagaatgaaatacataagcccaatatttggatgcttatatgccgtttggtttttcctgtttcacatcataagattatagaacatcttcttagctatagataaaagagacattagagtgtccaattcccttattttataggctatcaaagagattaagaggcttgtcccaaatcactgccaattagggccaaagccaagactagaacttgggtcttctgattctctacactgtaggggaatccacaaacacttattgagtccctatgatgtgcccgacattgtgccaactacaggagatactggcgaatagaacagactcagaccttacctaagtggagctttcagtgtggtcacgctaaactaataattcaatctgattaagtaaatcattgcaagagcacaagtgccttggaggagaagtgcagggttgggtaatgggcccagcctggtttggagggtcacaaaagcctcactgagaaaatatgttcaaatgcataggagttagctgaagaggagctggcagatattttaaatggtgccaggctaattcacaaaaccttctttgatatttgacagctgcattgtgggttaattaggccactgtggcctgccctatttgccaaagtgctcaggaaaaggcagtcagactcctgtgccttcgaagcagcaccagtggttccctcctcccagcaaggaagtgacaggagacaccgagaggcctgctctggagaaggtctcctcacccctcgctgacagggagtgtgggcatcttgaacatgacacattggttgtttttgccaagggagtgcctacaatgtgagctttgacattagagaaaaataagtccttagtccctggaagtggaaaatcttagtgttatttacaaaggcacactacaaggccttgtgtagcttcacctaactagtaaaaagcagactcttcaaaaggagatgcattccagtctctgttaattaccgttacatccggaggtcatcttcatgtttcctgtgatagttcagtggggctggttaatctgtgtctaagaaacttctactatatcctgccttactgttagaaaattcaacccaacaagcaatatgtagtgatgtggaacagagatgtatttaaactgagatagagtcttggggtttgatttccaattcttttccttactaggttgggaaaactgctttacttttctgaacctcaattttcttttctttttcttttttcttttttgagatggagtctcactctgtcacctaggctggaatgcagtggcatgatctcggctcactgcaacgtccacttcctgggttcaagtgatcctcctgcctcagcctactgagtacctgggattacaggcttgctaaattagcctggctaatttttatatttttagtagagatggggtttcactatgttggccaggctggtctcgaactcctgacctcaagtgatctgcccgccttggcctcccaaagtgctgggattacaggcttgagccaccatgccaggcctaaatctcaattttcttatctgtaagatggggatgataatgataataatttctgaatcttgtgagaggcttgagacattaaatgagaatatatgcgagagctttttaatatgatctgaagtgctgcaaaatgtcacttaaaaattaacttctgttatgtatcctcttttataaagctcaaattgaggctcagagagagacctggttagggctggagaaaggtctcccgatccgccactcagtttcttttcaccaggttgctgcactggggcctgtcttttagtaaagcaattgttggcgagagcaggttcctgggggaaatgaacatgtgccggaagggagggaaagagagtagagggtctcccttcaggggtatggagagggcaatggacggggagggggcagggacaaacccacctaccttctcagtgcgctgagggctctgaggctaagcccgctcaaggttaaggttctctactgctgactttctccatctctctcaatttgcctgtctttgtgtggttgaagctgatctagcataaaataacaggctttttagcacagtttgaaagcaaactcaggctttaatgatcagtttcctgttccttggtattttctttcaagcaaaggccatgtttttgtaatactccctttcaatggactgttctttcggccccagcaaacattcctgagtggtaggtttgaggaggtgttccaatttattgtttccggtgtccaataaccttggaggagtatctgtcttcatgccctccaaggccatgttatttcagaaagttacagcatttgaaatcattctctaataaaagcaagtgccactaattctaagtaaagtgagctttacaaataagaccagctatgaatgtttaaaaaaagaagaaaacaaaaaaacgaacttcaacaacaggagtccataagtgcaaactgtatgcagctgaacttcaggaattttagcatccatttaaaaagatatcttcggcaaattcatctaaattagctaaaaatgcttgacacgatgaacatgttgtgtctctaggccagtattcaatccaggtcaaggaatctaaagggtagatgtacctaccaagaaacaaagtgtttgtgaggtggccacaaaacagaaaagctgaatttgatttctttatttttttttgagacggagtcttgctcagtcgcccatgctggagtgcagtggcgtgatctcagctcactgcaagctctgcctctcgggttcacgccattctcctgcctcagcctcccgagtagctgggactacaggtgcctgccaccacgcccggctattttttttgtatttttagtagagacggggtttcaccgtgttagccacgatggtctcgatctcctgaccttgtgatctgcccgtcttggcctcccatagtgctgggattacaggtgtgagccaccgtgcccagcctgatttattttataagagcccagctgtggtcaggtccccaggggtcaggctgtccgccaaactcttctgtaccggcctctcctggggagggttcacaaacccttaaggaattgtaaagctgcctggggctcccatattaaaggcagaaagtacatctatttcaatgactagtttctaaaagcagataatacaatacatatttacacattttcctctttacaaacagtctgagaactatcaagggagctggtgtggtggttaggggaggtccggtgagtactttcagattcatcatcaggtccagacactcagatggttaatcaggcagctaagtcctcagctgccacgatggttttaaatcattctttgcttgacattaatattatttagttcaaaatggtttgttggttaagagcagggccataagaaacacgtagtgtatttaagaataaattatactcagttttggagggaagatcagtgactgaaaaatattggtgacttacctgaaactgaaattgtattttatctggagggcttctttacccataattaagtactgtcttccttttaccagctcagcgttagtacaggttacctttttaatgaaggtaatctcagagtctttctcagcaacagcttcccctgagagacatgcaagtcaagtaaggttataccattcatgttttaatgtcacaattataaactctcaagttttctggttcctcgtggctattgagaggttcatggctagtggacagccgtgatatccatgtggttaaggcttcagtctctggagccagactgcctgggttaaactctaagcatgctgcttcctggctatgtgactctgggaaaatgatttatgttatctgtataaggccttagaccctcatcttaagactgggcatgataataaaacctaccttgtagaaccatcgtgagattaaatgagttaatacatgaaaagtgcctggaacatagtaggaactatgtaagtacttattattactcttatataaccagaattaaaagaacctctctacagttgaacaacattaatctccacattatatagtaaaatataaaattatttggtatttggcaactgttaactttgtggaaaagtacaaaatgtgaaagacttggaaaacttcaaagatagtaattttgggattctcaaagaactcacaagtagccagttcccctacctggaatgcattcctccccatgttggcctcttgaatttcatttatcttgaaagtctccttcaattctcacagtatccagtaaaatattcctggatgctctttgttttaaatatctttctgtctcctctttacctcttttacacttgaatttctgtcacaattttttgtcccacatctgtccttctagctagactagaaacttcttaaggcatggactgtgtctgatttatcgctatatatacagggctgatatttaactattaagttctggcagagtcatcttaattgttaagtcctgaaaaacttctgaaccaattggcaaatagtgtataatagaaactgtgtaaatggtaaactttcattagtgatataaatttcagtgtacacccattagttcaagctgatttcttaggctgccctgatggtgtagattcctattacgtcaatatctgagcaacattaccagtactatctgccatttcagcccctgtcatagtaagcagtgtagctgtgtggggccttattattttttaagcttctcatcatggaaaatttaaagtatattcagaagagagaacaggcaactaccctgggcttcaacaataactaaacttttattcttctatatccttacctattctaagcactctgtgctttggagaaataccaatttatccttatcctcaaactacagtttgcccttgattctaaatggcttatggtcactgtgccacaattcttctgtaagtagtgtgtggtatttttatatttataaaaattcaaaatttatgtgttaaaaatgggcccagaatgaggagatgaagtatgccaatgtttcttaacatttccttttaaatatcataaaatgcatctttggatctacaggagaacaaagaagaaatgatactaataaaaaaattgtagcttgggaaccatccgatgctatgaaaaattcagaacagtctaaaatgtcttttgatactatgcaagaatcagtatcaaataaaacaaataatttgtatttctggaatgaaaagcactttgttatttcagtaaaaagagaatggcttattactgcttgtaatatgaacattggatgaaaatgttgctcaaaagttggactgtggcaacatcaaagttctaaacacttatttcattagaatggcaactagcctgcaaattaaaaaattgtgaccatcaatgaagaaaaaaataaaataacttcacaaataagtttcatacaatgaaactttcaaaataacaaaaatttaaaaaaaattatcaaagtgttgataaagcaaatacaaaattgaaaaatattactagaattttaaactctagggtatggttagtaataatcaagctgggaggctgaggagagaggatcccttgagcctaggagtttgagaccagcctgaacaacatagtgagaccccgtctcaaaagaaaaaaaatcaagcattttaggacttgaaatatttgatagaatttcaaaagagaaaaaaatttagtataaacatattattgcaatttagctttatggtcctacttattgcaaaatttatatcaatcgaaatgaggccaggcacggtggctcacacacgtaatcccagcatttcaggaggctgaggcgagtggatcacttgagcctaggagttcaggaccagcctggccaacatgtaagaccccatctccgctaagatacaaaaataagtcaggcgtggtggtgcatgtctgtaatcccagctactcaggaggctgaggcaggagaatcacttgaacctgggaaacagagtttgcagtgagccaagatcgtgccactgcgctccagcctgggtgacagagtgaaacgtcatttcaaaaaaaaaaatgtaatcccattcacaatagccacacacacacaaaaatgcctaggaatacagctaactagggaggtgaatgatctctacaatgagaattacaaaacactgctcaaagaaatcagagatgacacaaacaaatggaaaaacattccacgctcatggataggaagaattaatattgttaaaatggccatactgtccaaagcaatttacagatttaatgctattcctatcatttttcataaaattagaaaaaaacattttaatattcatatggaacaaagaaagaacttgaatagccaaaggaattctaagcaaaaagaacaaagctagatgcctcctactacctgatttcaaactatattacaaggctacagtaaccaaagcaacatgttactgatacaaaaaaagacacgtagaccaatggaacaggttacagcacccagaaataaagccactatcctaagtgaattaacacagtaacagaaaaccaaatatcacatattttcacttataagtgggaactaaacagtgagtacacatggacacaaagaagggaacactagacagcagagcctacttgagggtagagggtgaggattgaaaaattacctattgggtactatgcttattacctgggtgacaaaatgatctatataccaaacccccaaaacatgcaatttacccatgtagcaaatttgcacacgtatcccctgaacctaaaataaaagttgtaaagaaaaagaaattggacaattacgcaattgaaaaaaacattttgctgaagttttagaaaaatgaattcaatgagaaatatttatacgaacatctttaaaaaatgtttctccccaagtagaatataagctttaaaaaggcaagagctctgtcttatttgagttgtatcttctgtgtttaatataatgcctggcacatagtcagtactaaatagttgctgaatgaaggaacgaatgaacgaatgaattctcaccagttttgtagatatccagaagggttgccttgtacttgacaaaaacattttctacagtgatggatgtgatgctaactttataagctggcaaaagacaaacaacaatgaaacaattcagtcttaatactattaatgctatgtccagtagaagccagaatttgtcaaacacgagaaatgaagcatggcaaactattatagttcttatttcctccaagaagccttccccaatcccctcagtctgattcaatctctcaatctattagaatcattagccctggccaatgttatagaacaggctgattagaataagagacatatttaataaaataacagaagcacataaaacaaacaaacaagataaacctttgttagatgttaagttcagaggctgatcctttaagatgagtggagtcatgcccatgggcatcttttgaagagccccttcattctcttctccatggccacagaggaggccttatctctcattcaggtctaccatgtgagctttcttggttccttgctttgcttcctcatatagttccactggctttaatccttggtttttaggatgattctgttttctcactcacccttgcttggcaactacctaacaagagctgcctacaatcctgttttcccttcattcagatatcaatgtttgatgcataatgtgcttgacctcaggtctggaaagaccagcttgaagggacccattctttctatgtggcctcaggagagatttattttatttttgcttttgatctattttttgttttgaaattagtgacctaaaagatttgttcattctagatatccctcaagtctttaagtctatcccagatatagattgactgattgagaggtagctaggtgaactcatcatggcagaaccaggggctatgtaaattagtggcttaaaatgcatgaaaagtgttctgactttcagattcataagtctttataatggacatgggcaatgtacttactatgtgggcctgggtacagagagagaactacttaattttgtttctattctgttattctggcttgtagtccagaaaaagccagcgaagtcttttcttgaaacaacacaataaacccaaattgcatttattctctgtgttaaaatagatttctgatattttagatttaaaatagttctaaaatggagggaagaaataatttagtggaacttttgtttgttaaaacaatatagtattctcaagtcttcatgtatttaacaaactgcagtgggcctaggctgagtcaggcagctttttagcttttttttttttccaaaatcaatataaattcaaagaaagaaaagttattaaccatataaaacttattctgttgcctgaattactattaagagaattcagtagacttcgatggaaaaaatactggagatcaggatgcatcttaattctattacttgctttctgcatgaccttgagcaaattatttaatctccctgagcctcagtttcttcactggtaaatagtgataatactctgttacattttttttttgacagggtctcactctgtcactcaggctggagtgcaatggcttactgcaatctccacctcccaggctcaagcgatcctcctacctcagcttcccaagtagctaggactacagacatgagccatcaacgcacagctaatttttgtattttttgtagagacaaggttttgccatgttgcccaggctggtctagaacccctgagctcaaagtgatccacctgcctcagcctcccaaagtgctgggactacaggcatgagccaccgcacccagccctcatgaagttcttacgagaccctttccgtaagaatgagaaccctttccattgcaatgagaaactgtttatggaagctgttgctaaacacaaagtaccaaattggctgtgtttatttttttaatttataaataacacccttcaaatttctttctttctttctttctttctttctttctttttttttttgagacagagtcttgctggtgttgcccagactggagcgcagtagcacgatcttggctcactgcaacctcctcctcctgggttcaagtgattctcccgcctcaccctgctgagtagctggaattacaggcacgcaccactatgcttggctaatttttgtatttttagtagagacagggttttgccatgtttgccccaggctggtctcaaactcctgacctcaggtgatccacccacctcggcctcccaaagtgctggtattacaggcatgagccactgcgcccggctccacccttccaatttcaaaatgaaaaaatgatttgagatagtgtacaatatgctctctctctctcaaaaaatgccagcaataaacatcaaaaactgaatagataacaaaggagctaattttatcaggaactgagacaaggctacaactgtacttgaacactaatttagctctaagcgctggacaactagaagcactgagatttgctttttcaaatggagagtgtctcaaacatggattgcaatcttgaatatattaaaaattatttggtatttatatttttaccctgaagatatttttttaaaaaccaagccccctaaatcacctttgcctctgcctctggtctatcaattggaagagtacagaactgaaatcttatacctctgtggcttctcaaaagttccctttgactatgttttagtgcctgtaattgaaaaagctctattgtgggaaagtatcctggctgggtatacatgtcacttctattatttataatgaaaatcacatttctttgctgaggaataaaaactttgcatgttaatgctaaaaatcgatggcattttccttcaggggatcacatggaatgttgtattcatataatcactatataaagtttttgatctttctaactgaacacatattcataaaatttcatgtttaaaggagctatattgaacttttgaactcaccatatgcaatctctggtttacatgctgtttgttttcttgtctctgcagagattgtcagatccaattcttcctgcatttgcccacaatcagctggattttgtgaaaattggtaaaaataaggttaatggaaagaagtagacactctttccaggagtaaacacggtttctcatgagcccagagacaacccaatataaccttacaaatgtcagatttctaagacctgcccattttcttttctttcataaagtgaaatattacataaagaaaacaaaacaaacaaaaacaaaaaacaaaatcttgagcatgtcacaagcttgtctaacccatggcccgtgggcagcacacagcccagggcagcttcgaatgcggcacaacacaaattcgtaaactttcttaaaatattatgaaatttttcttgtgatttttgttttagctcattagctattgttagtgttagcgtattttatgtatggcccaagacaattcttcttccaatgtggcccactgaagccaaaagattggacacccctggcataagacttattgttagactgggtggctactccacattcaggtctttagaaatgtatgtggttcccttgatgaaagggggaaattttccattttgagtataatcagaagtcctttgaaggacccaaaatgataatgtgactgatttatagctataaaatggcacaataagtacctagaaaatgtgtagatattgaggattttgaaaaaaccaaaactaactgagaccctcatggagccagctgttgattattggtgagttctggatcttttccttggccaagaaggctttcttcaatttaggaaagactaaatggaactggacaataaaccgaattccattaactgggaagtataagagaaaaggaacagaagctagtggttcagtgctgagcctcttgtcttatatgataaaaagactaggtgaaagtaaaatctcacatcatgttgcccctataatattcaacaaccctctcgatggtgtttccctgcctctgtacagcatgaactatcaggttgttcaggaactgtgaaaatgtagttttacaatgctcaaggaatcattagctttcaattagctgagatagcatttctacttctgagaaagaacagtttaccaaacagtgtcccccagattaacctcaggttatgaacgactgctttaaataagcatgcagcctaaatatgttaaataaagtttaccttctacacacttgcacgcggctccttcacagactttctgaattttgatattggaagtgctataaaacatggtacactgtttatctgtggcaacaaaagtgtggttaagagaagtggtttgattgaagaacaacacatttactaattggcaagtgtcttacatggagcctcagagattgcttattttaaacccttctttttatagctaaggcccagggaggtaaaattatgaattggctgtcctgggaagggttccgctaccctcagaaagatctcccctttttcacttagttctgtgcttgaaacactcgtttctcagaaataaaacatttgatgcttctctaagtaagaggaaaataaattatgttgcatgaggatcttttgaaagagttggaattgtttagggtggacaagggaagaaaagcatatatctatgtatctctatatatctatctcaaggggaagagggactatgtatgttctatgtgatttcagaatataaaactagaatgaatgggtgtcagagttttggttcacttcaagaattttctaacaagtagaactgcccaaggtggagtcatctgtcttgtgatccaataagctctccaaccacataacattctcaaaaatggctgaatagtcaaatgtgggatcacccattcataaatatttattgagttcacattctatacccgacgctgcgttagatactagggacacaagaatgaaaacaccctggggttgatgaaaaagacatacaaataattgaatgcaatgtgacagctgctataatagagctatctgcaaagtgtaacaagaatatagatgggctagaagttgttctggggggattgagttgatttctctcaaaaggagagatatgatttatctgtgaacaccatagataaacctgaggcaaagaatattgaagttggaggcactataatccagttattttaaatatgaagaaactgaggactgaggtgaaacggtctgctcaatgtcaagaagtagtttatgtacaatattttgtatgcagtagttttgaatgttcaaattgggactttcatgaagagtggtccctaagagaggcaatacataaaatttacaggactctagtggatttctaaatgttctggaaagaatacaaagtattcttctgaagaaatgttagcatggagttgattacctggtctgtggtattcgtacactgtgaaagtggcaggactgagaaacccaacttcaaagagttcaaatatccggaatcgtacacaaaggaaatcactggagggaatctgtttaacaaattcaaggatttaaggaaattatggagagatgatatttataatcttttagcctgtatattttgaatagtaatagtaaaggaaaaatggttgcaggtggagcttaccgaattcagttgcagaataacatgtccatctttgatttggtaatcagtgaatagttgatccaccccttccacaagctaagggggaaaagagagaagcttgaatttcatttcattatctttttgtttaaatgcattcacctgttgatgagatagcacaatgcagggatgtgatctgtaattcaaagaaattgaagagcagttcctcttcttgaaaaagtctgaacacattagcatataaactcatattttacagagcatgctagtgtatgcttctgcttcactttgataaatcaaaacttaggttaattatgttttgaaaagaatattctggccaggcctggtggctcacgcctgtaatcccagcagtttgggaggccaaagccagtggatcaccctgatgtcaggagttcgagaccagcctgactgacatggagaaacctcgtctctactaaacatacaaaaaaattagccaggtgtggtggtgcatgcctgtaatcccagctactcgggaggctgaggcaggagaatcacttgaacccgagaggtgcggttgcaatgagccaagactgcatcacactccagcctgggcaacaagagtgaaaatccacctccaaaaaaaaaaaaatattctgggtgattctataaaagtggtatattcaaatgaaagaaagtaaaattgtctataaaataattcagaaaagaaaatgaagcattcacaacacgatttaaaagaaaacacatacggcttttaagtcttcttcatttgcactgattccagtaggcaaggagatgtccatcaccgcatgagaggatccagatgatgattcttccctgctgggcttgtagctaaaataaaaaagaggttagaaaatataataaataagtgaataagagtctttaagaaaggacactcttccttagtagaccttaatttttaaatttgggtctccatttatttgcttttctacaatgtatgggttaaaatctctgactttagagttgcaagagatctttgagtcatctattctctttcctcacttgatcaataatctcaacagaccactctactggaacacagaagtcatccacaccaagctaactagctggggaaactcaggatgagagtaaggcactggttcaaggtcacatggctaattcatgcagagctacagaagaatccaggtctttggattctcacgttagttcattttctaatgaagcatattccaaggaaaaaatcagttgtatgttgaaaagagattcaataaacatgtccaggaaaagctggaagaaaatacactaaggcaaggcacggtggcttacgcctataatcccagcactttgggaggccaaggcaggcagatcacttgaggtcaggagttcaagaccagcctggctaacacggtgaaactccgtctttactaaaaatacaaaaaaaattagccgggcttggtgggacacacctgtaatcctaactacaggagaattgcttgaacctgggaggcggaggttgcagtgcgccgagatcgcagcactgcacttcagcctggacgacagagtgagaatccctctttaaaagcaaacaaacaaacaaacaaacccacaaatattagtagctactttggatggtgagattataagcaattatctcttttctttttcatgcttttctctattttctatatttcccataatagctactttatatagaaaatgtttcaaggactgtcctttcagtaggaattctgctagtaggaatttaagcggaaatgcaaaaagggcacaatgggagggttttgtttttgtttttgttttgtaagagagaaaagaatactgaaatggagaatcaggaaacttgggttttattccagttctgagattcccacaaatcatttcccctttctaagctcattttcttatttgtaaaattaactgtgaagaagtataagtttgtgttttaaatttatctttataattcccaggctttggttttgggtggcagaggcttagagctaccattaagagatgttagaagacataaaagagacaggctggcggggctgaggctggggcagagacagacggagtgtgattctgtaaaagttgatttcaggttccagcctcacctcaagatgcttgaaaggcagctggatgtttgagagtgaagcttgggagagcagtcaggattaaaggaagaaattaaaagacagcttcataaggggtaaaatgaattgatctcacctacaggtatgaatgttggtggaagaggagatactaagcaagttagtgaggggtcagggcatatcttttcctcaatgacacctcatagagcatatataatgcagtcccagctgggtgcggtggctcacacctgtcatcccagcactttgagaggctgagtcagatcagctgaagccaggagttcgagaccagcctggccaacatggtgaaaccacttctctactaaaaatacaaaaattagctggctgtggtagctcacacctgtaatcccagctacttaagaggctgaggcacgagaatggcttgaggctgggaggcagaggttgcagtgagctgagatcgcaccactgcactctagtctgggcaactgagcaagactctgcctcaaaaataaataaataaataaataaataaataaataaataaataaaagcagtccccattagaagtcatagatgtaatatttgccacaataaagaaaagtattctaaaatctctgactcataaaaatttaaccctattcttcaccaaattaacaatttagaacagaatataaaacacttggaactctaatgtgacatccgaacatctccctaattggatgggtagaagcagagcactcttgctcacagatgcaaacactttgtcagcaggatggaaaagggcctcccgagtggagagtgtctatgaaaaggttgctggagccttgatgactggttgccatggagactgtttcaatggtggaacagaaatcctcctttcaagaagccctttgcctgctgccaaaaccagcaatcttccccaaaggcattttgttgtgagggaaatgaaatccttttttcttttcttaggaatacaacagagaggttgtaaaaaggtaaatacacgaaagagaccctctgaacacagaaacttcatgctggcattttttaatcaggagagagaatatttgaaggcaaagaagttcctacatgaataagtactacacagttccttttggaatttacccaacctaacttcagtgtcaacagagccaaaagcatattccacccgcctttctggaacattttgtccccaatttgtaaaaaccaaaggatagactattcaagattgcatttctccttgctttcttttgtatattgataatctggaattaggcctcctgacaatgaagtcaaatgaatgaatttttgataacagcttttttctgtacggcagaattgtggataattagaactggcagaaaacttgagataaggtagtgcaatatctttgctttatagaagaggattggagaagtaaactgatttcctgaaggtcactggagttcttactggtagaggctatcccacaggtgtctcaccctatcagagagctcttctttattgcaagtctagatgcctccctgtagggtcccaggcactgattcgagctctgcccagaagtttgcttacacttccctttgacaactgttacaaatttaaaggtaattgtgatcatgctcctccccagctggtaggtgcccaagggtaggaatggcatttagggggaaagaagctgcctgggaaagggcgaccttactggaaagacattagggaatgaggaaagatgtttgagcgggaacagagagcagggactggccacagaaggaagtaggaaatgctggaaggaagaaatgctgatgaggaaggaaatagggctgaatagtgaaggaatcctaagaagcgattgggcttgggacatagagaagactgggaaacagctgggagggaggcagggagaaactatgtgctgttccttgggattagtggtcttagattacactgattgaaagaggtggtttaggctgagcgtggtggctcaggcttgtaatcccagcactttgggaggctaaggtgggcagaccagctgaggttaggagttcaagaccagcctggccaacatgctgaaaccccatctctactaaaaataaaaaaattagccaggcatggtggcatgtgcctgtaatcccagctactcgggaggctgaggaaggagaatcacctgaacctgggaggtggaggttgtagtgagccgagatcacgccactgcactccagcctgggagacagagtgaaactccatctcaaaaaaaaaaaaaaaaaagatgtggtttagatactggattgaacatcagaggttggggatttgagcccctagctctgcctctaactctgtgagcatttggcaggcgactttatctctttgggtcttagtttcttcatttccaaaacaagaggattatgatatcatccctaaggtccttctcagctctcatcttttgcacaacactattgaatttccaagttatccacactgggtgcatgattataagtaaaatcagcaaaatgccatccacagatatcactgttattgacaatacaagagttaagaaaatagaacacaatagaaaggactgagggacgatggaaagaacagggaagaagtctgtgtttcagtcctggctctaccactctctgatcacactgtgtgatcaccaaagccaaaagtatatacatattttcaaatacctacatattcttttctttttctttttttttttatttggagacaaggtctcaatttttcgtccaggttggagtgcagtggcgtggtcacagctcactgcagcctcaacctcctgggctcaagcaatcctcctgcctcagcctcctgagtagctgggactacaagtgtgtgccaccatgtctggctaatttttaaaatttgctgtagagatggggtctggctatggtgcccaggctgttcttgaactcctgggctcaagcaattctctctccttggcctcccaaagtgttgggattacagtatgagccactgtacccggcaaaaaacctacactttcataaatgttttaggatggtggctgtggtaagcagaataatggcccccaagggtgtccatgtcctaatcccctgaacctgtgaatatgttaccttatgtggcaaagagaactttacagatgtgattaaattaaggatttgagatagggggttatttgtgcaggcctaatgtaaagacaagaatctttatgaggaaaggaagcaggagagtcagagaaggaggtgtgatgatggaagcagaggtcacagtcagattggaagatgctgtgacactggtattgaagacagagaggggccacaagccaaagaacacaggtagcctctagaatctggaataggcaaagaaattctagagcttccagaaggaatacagccctacccagctccttgattttgggacttctcacctctagaattgcaagatagtaaaactgtgttggtttaaaccattacatttgcaataaattgttacctagcaataacaggaaactaatacagtggccaattgaggcctcggtatttagttgggagagggtttaacatcagtggttctcaaccctggctaccattagaatgacctctggagcccgggacatttggacagctctaagagctctccagctgacttcaatgtgcagcttgagttgagaatctagctgataatggattttgttaggtaaatgtgatttttctaagtaagagagtaggggctgtttttgagagaatcttttatatttttttcctaattttttaaatcacatttctatccctctgaaagagaaaaaattaatattacactgtttgaatcagaagacaaaacagacagagaaaactattatgagcaaaaccaaggctgttttttatggtaagtagcaatttaagaatatatatgttctgcatttttaaacaattgaacaattttgtatcttctggacataccaaaatttgaaaatatgtaaagaaacaatacgttaacaaaaatgagaacttggagtctatgctcccctttgtggaaataggctcacctggcacatgctactatgcgtttgtaatcagagtttccgtagcctctgtagtgggatgctggcacataagacaagaaaacaaacagacaaatataagagtaaactgttttcagctgctttggaacctgtcagaacagaatcattaatgagcaaatctttgaacacacttaaaaatgatttgtgatttggaagtttagatactttcagtggttctaatggaaattcatggctattgacaataccaggaagtctttaaataattaacagttcattgctctcaaataacttataatttaatgaagaaattattaaagataaatatgtattggtaatatgtttgggggatgttggagggaggaagaacagatgccttaatttgctggtagttgggaagtttcctgtaggaacaggcttctgagcaatagatggaaaatatcagggcagaggcagcaacattcattctgaccctggaggcaatggggagaccaggaggactggagtgtgcaagtggacttgcttttggaccaggaagggagaaccaaccagcagagggatgtgagggccttgggttaaataaaagggtcaggggtacatttaaagaaaggatggtacaggagagactaaaaaagaaaggggtacaggagagactaagttaaagatggaggcagagaaatgtttattttctgggccccttggaatacagaaaggctaagggatggaaaactaacagggtgataagagaattcaaggtcccagattggaaggctaacacaaaagtaacagaaattcctggttctggaattagaccttaatgtggctttacaactagttacactctttaaaaataacatagtcaaaacaatttattgatcaatagcaaatacatttagcttagtcattgttatttaatattagcttccgactatattaaagagttatctattgtaaaaaatggaagtaatatttacttggatgtcaacctgctaaagtatttggttaagaaatttcactttttgagtaagcacatttttactaatcagagaagctctctatttatacacatgctttatttttagccaaaattacagcgtaaatcctgctgtttttaccttcaatatcctgagtatcgattttcaaataaaagctgcaaacttcctcagaggtactggttttgtgaactacagttgttacctacattggggacaagtaagcaagaagattctatttaaagtgggaaagtgacaaaggtattatggcaacactgctgctgcagatgggatgctcgaaggatcattttcataatccagcacaaatggtgtacattagtgactcatttttccagcagctggactttaagcaaactccataatctaaacctgagaggcccaaagtaagcaaaaaatgacttctggccggtcagaagcttggtctaaattccatgcagtcaaatctgggcacctcactctacaggagagttcccaaggttcttgttttgaacctttccactttaattttacacacaacagcacaaggctaagaagtgtgggtttcttccagccacacgccatcatggcaaacaacaaattataggtgtgtatgaatgggcagaggtgctgccagaagtagatatattgacaccaaccagaagtggcagaaaagtggacaatctctcctcccccatataaacttacaacagtccttgaaggaatgaatgcactaaagataagagcgtgattaaaattattaataggatgttaatttatgctcagaacatgcaatttaagaatgcatgaaaatacttaaacagcctagaaaaatttgcacctgccagctgggcgtggtggctcgcgcccataatcccagcacattgggaggtcaaggtggacggatcacttgaggtcaggagtttgagaccagcctggtcaacatggtgaaactccgtctctactaaaaatacaaaaattagccaggcgtagtggcatgtgcctgtaatcccacctacttgggaggctgaggcaggagaattgcttgaacctgggaggcggaggttgcagtgagccaagattgcaccactgcactctagcctgggtgacagagcaagactccatctcaaaaaaaaaaaaaaaaagaaaaaaaattgcaactgccaagtggctaaaatgaagaaataagtctttatgaataacacataaatcccccaaaatcctggataaatgagatgggatagaaaacatatatatatacaatgcacatatgtacacagatatatgtatatacacatatgccatatgcgtatacacatatataatcataaaattatatatctctataaatatatataatttctataagtatacagaatgtatacatataaggattaaatttttttgtgtgtgtgagacggagtcttgctctgttgccaggctgcagtgcagttgtgccatctcggctcactgcaacctctgcctcccaggttcaagtgattctcctgcctcagcctctgagtagctgggaatacaggcgcacgccaccatgcccggctaattttttgtatttttagtacagacggggtttcaccgtgttagccagggtggtcttgatctcctgacctcgtggtctgcccgcctaggcctcccaaagtgctgggattaaaggcgtgagccaccatgcctgaccaacattgttattttcaaaaaaattgtgaggatagttacaaagattgctagaaagatttacataagtgaatcccactttagtcatggttacccaagcccagatttctgtgactttgtggcaaagctcctaacttttatgttacctagtacaaatggacacataactcgttattggatatcaattaaatacttacatgtactgtagccaagccactgccaaatcctgtactgacaatgaggtcatcattgagaagcacctggaaagataatagagaaacaaaccatgctttctttcatcatttgatagggagggaggatagagctatgaaaagtgggttgacatgtaccagcctcctctctcagagctcttctgagagtaactggatgagacactgaaaatcctatgcccatggcaggtgctaaacaaggctggtatttcccctttcccttctacatgtaaataagatgtctgagatctcctgagtgaaccaacaaaagcaacatgtcagaggtcacttctggttacattttcatttacatatggctatggtaaatctggatcttcatctccttttgccaactgaataaattcctttctgtgcctagctcaggaatcagcatcctgtgtgccaatggagatcgttttcattagaacccagagcagggaacctccacataacttgaaagcgggtgcatctatctttggtcctctctgagctcctcctttgcaccccttttccatctcttgatgatttatcttttccacttgtcaccgcctttgtttgcagaaacccctggtaccccaccccaaaccactagcaccccactcaagcctgccaaatccttagttgctgctgctcttcttcccactctgctaggaggaaactgaagacataaacggagttaagtcattctcctctccagagaaactctgtcatccaaatgctccctaatttgtggaaagtacaggagagataattttgagcccgaggggttggcacttcctttactccaagcctcccctttcctttgcttagcacaataatgcaagatggattgggcatatgttaaagtttctcaatccttccttcaaattttagtaaatgtaggaaagtaggtcaacattcttgttctccctgatagaatatagcagcatttgttggaaaacaggtgtcttgagatactgcatgtgaaaagcatgcatgacaaataagtttgggaaatgctgtgcactgtgccctgcctctgccccttttcacacccagagtcaccacacttaatcacatacatgttacagaacaggggaattctggattaaagaacttgtttaacttaatttaaattaatttgtttaacttaattaatgcacactcaaccacctaacactctttcatggaacacatttcaggaaatgctggagtagaaaattccacactggataataacagcccaggttttacatggaagcagcatcctgggctggggtttaaattttgttaggatgacaagaggcctcttacagcattatccctatagagaagaataatttcagctacctcaggtagctggaaggtcaagagatccttcttagagcttagactcagaacatgaatctccggtgaactctaaatgatcccagggaaaggagacatattcccaaactagggaccacaagcacaaatgcctgcagaggcccgggcacaaagcaggtatgaacataaatgcacatgcatacgtcctgtgactggtggggactgcagtaaattgtagaagccatgccaatgcctggtgctttgctttcaggtcttttggtttatcaagggaagttgggaatcaggtttttatttgaaatatctggatccttaaatgttggcatatatctatgtctatgtttatatccatattcttttttttcagtatgggccaccagtttgcaatttttgcattaaattttatttctctgctgggcatggtggctcacacctgtaatcccagcactttgggaggccaaggtgggtggatcaccagaggtcaggagtttgagaccagcctggccaaatggtgaaaccccatatctaccaaaaatacaaaaaatgagccaggtgtggtggcaggcgcctataatcccgcctgctttggaggctgaggcaggagaattgcttgaacccaggaggttgcagtgagccgaggttgcgccattgcactccagcctgggcaacaagagcgaaactccatctcaaaaaaaaaaaattatttctcatgcttgtttacttttaacaaacaccaatttgtgaaggatgtcaacaatgaggattatttccaattactgtacatttaaatatactttaaaataatgcaaacacagtaattagaaaaatatgtatcagcagctatatgtgggcagctaatattaatatagaacccagtttttccaacatgtcttgttctttgtgaaattttcataagccatcaaagttaccacctttaaaaatccagcagtagcaaaggacatggggcaaggagctggggaccctaaaggccaactccaacctggccacagtctgcatgtatgaccagggccagaagggaccaccagcagcctcccagacatgccttccctcctacgctcactgtactgctctgtgcgctgttatctatgtctggaatgttcttcctttttcttcacttggctaactcattctgattttttcagatttaacccacacatctggacacatctgacaaactccctccatctttcagccaggatcaggagggcccctctgtacttccatgtacctatcaagactcttatttttcactatctgcttaaatgacaatctccctgcactacgctgattgtttgtgttttatttttgaatcctcagtgcccaggatatagcaggcatccctgtttaggacatagctgacactcaatatatgtttaagtagtgaagagatagatttataaaataaagagtggaacagatgatttcaatggtctcagccaattgtaaaatactacagaaagttcttcatttacctctactggcctcccaaggaaattcttgtctgtcattttataattatgtaaggcacctttatgcttgtaagaaacatcgatgtccatactcaagcggagttgtttaaccaggagtgaatattccgtcaggccctcaatggcattgattgtgtcctgtcagcaatcagcaaggcacaaaaatatgtttagtttatttatgtactccctatttacaaatgccctttttatgagagggtagggcagcattgtctggagatgaaactccagctgactcagtaagactggttaagagccccattgtggaggtggaagaaaggtctctccctcctcaataaagatgctgttagcagggacaggaaggaagtgtggcctcagatctgggtcctctatatattctgcaaatgtaacctcaggcaagtcactgtttgcagaattcatctgagtctttgaacaattatctcttcctcatcctttagtctgaccttaagtatctccacaacaaggccataaactcccctttcccgttattctctgttttaaggttccctttttgccctttctagcattcatctcaatttgtaatgcttttatttatagtttattgttggcctaccccactgcaatataagatttgtgaggcaagtaggtaatatatttttcttggtgcctgctgtggtttgaatgtgtcccccaaagttcatgtgttggaaagcttggtccccaatgtggcagtgttaggaggtgaggcctaatgggaggtgtttgggtcatggggcgtaccactttcataaatggattaatgctgcttattatagaagtgaatttgttataaaaagatgagtttatactccactcccaccaaccctccactctgccttctctttgcccttccaccatggaataatgcaacaagaatgccttcaccaggtgcagcccccctgatcttggacttcctaggacccagaaccatgaggtaataaatttctgtccattgtaaattatccagtgtgtcgttttttctgttacagcaacacacaatggactaaggcaatgtccattgcatttagcaggtacataaatatttgttgaaggaataaatgaataaactttatctttctggacctcatctttctcatctataaaactgagaaacatgactagatcagagatgttaaacaatgtggccattccctctgcctatatctgtggcggcaaatgctaatcaatagggcagtcttttctgctaaccctataattgtacccaaaataaaacacattacatggtcagtaaattaatactgaaggccctctctacatctaaattacatatatataaatatacacactccatcattatctaaacatccaggcaacagggaagatattaacattcgatctaaactttgaatataaacatgtattatacgactacataataattagttgtaataaaaatacatactcaaatgagtttacattaaatagctagatagattaacatgtaacaatcagtatttctcccactttttatttatttcgttgtggagaaggagcatcagtacctttgtctacatggcaaccactatttattacataggatatgatataattgccaataaccttactagcctttcatggtgatttagaatcatgaaggaagtactgggcttaaagtcaggagacatgagttctgattctggctctgccatgaattccctgagtaaaactccctgggctaatttcctcttctgtataataagagtgttgacgcagataacctgtaggggtccttcaattctaggcattattcatatctattgcatgctcatttggtggacaaaggcatggaggccagatgagtgtggtgggggagaaaataaaaatgtctacagggagatgaaacaagacaaagaaatgttacctgggttgaataaaagccacctccatacctctgctcttctgatagccatttgatgactgggttaacataatttatatctttcaagttcagactggtgagtaaagcataggcagttgtttctaccatacgtgccgtaccagtgttaggtacagagctgtctttatgctgaagattgtctttccaaaaacgataaatgggtggattacctgaacatcaacaaattccattcattaatatgattaaaaatgtgaatttgacataataattctaccaggtgtattatggccttccagtttctagaagctacttactttttcttgttagaggaacttcctgaagatgaccaatgcaaaacgagatcccttaatatggtattacttgtctttacacattgagcatccctaatctgaaaatctgaaatatgaaatgcccccaaaatctgaaagtttttgagctctgacatgatgccacaggtgggtaatttcacccctgacctcatgtgatgggtcacaatcaaaatgcagtcaaaactttgtttcatgcacaaaattattgaaaatagtgtgtaaaattactttcaagctgtgtgtaaagtatatatgaaacataaatgaatttcatgtttagacttgagtcccatccccaagatatatcattatgtatatgtaaatattccaaaatctgaaaaaaatctgaaatctgaaatacttctggtcccaagcagttcagatcaggaacactcaacctattttttgttttttttgtttgtgtgttttgagacaggatcttgctggcacccaggctggagtgcagtggtgtgattgtagctcactgcagcctcaatctcttgggctcagtgattctcccacctcagcttcctgagtggctgggactataggggtgtgccaccatgccaggttatgttatccagcctggtctcaaactactgggctcaagcaatcctcctaccttggccttccaaagtactgggattacaggcataagccactgcacccggcctcaatctgtattttaaaatcaacatagtacacatgtactaggaaggggcagtttagtagagtcgaaagtgcaataaactggtattgcacccagcttctagtctttcttttgttgctaacttaccatgtcactttgggcaaattcctttagttctgtgtgactcaatttcctaatacctatagtatagataatactttcttccatgcagtgaaactcaaatgaaatactaaagtaaaagattttgtaaactagaaagcaccatgcatatataagggattattattattattattattactgacactaaaaaataaactggagaacctttttcctgataggaaaatttacatcctggaaattatgagattaaacctaaagccttagttcagtctttcattatttctttccaatttaaagcactcaagacaatttcgtacatgcagcacttttcataaattaggctgtaaattatatttgttatttaaacctgtaaacctcaaatcctttttggaacaaactatttgttttaaaaaaagtaatgcatatttggaaatcatatttgaaggttagtaaaaattttgatgtgtatgtttataattcataactacattatttgcatgaccttgaaaatgatattgacccttcctctcagagtctcagatttgctgtatttaaaatgaagagttgagtttaggattttaaagaaacccaactggaacaactcttggattattaagttcccttctagatcttaaattttatgattttatgacccatatctcacaatacccaagacatttcttttgtgttatttttgaagtatcgtacaagtggttttgaggcatatgttaaaatatagtaattttaaaatgatggcacaaatcatattttgtagatggtcataaacctcagtaagatttataaagccttagctagaagaggactccaaagtgcccaaccatgctaataatcactgctactctctttctattttttgtctcttgacctataggaagcagtatctttattcttcaaaaccaaacacatacttttatagcaaacctggtaaaatataagccaggtcatgcactcctttgctcaaaatcccccagtggctccccttttcactctcaaagctgaaattaaagttctagggctccttctggtccccacagcacattgctgtggataagacatgggcactccttgctctaggtggaagcagccctaaactagggtatgtggccgggggagtggagcacaggctagatttcagcctcgattcacttgattgcttaggtactttgtccacggcacaactgtttacagaagccctgaagagtctctctaatgccttaaatgaccttcccttgctccctcactttttccttacctgacctcacttcctactcctcttctcactcctctgcagtcacactggcctccttgccattcttggagcaccaggcatgcccatgcctcagggcatttgcacgtgctgttctccaccaggtacttccttctagatagccacaggaattgcttcttcacctcctttcagctcttgactcaaacaccatcctcttagtgaaacttaagcccagtcagcttgtctaaaattacaatgcatcctctcaccttattttctttccctgctctatttttcttcatatcagccatcaccatctattcataaagctttatttatttatcatgtttgtgtctccccagttagaatttaagtttcatgatggcctggattttggggagcctgttttgtttattcctttattcccagagactggaatagtgccaggtatatagggggtgtccagggtgtacataggatactcaatgcatatttattgaataaaggaataaatagaggacaggtgtggtggctcatgcctgtgatcctagcactttggaaggctgaggcagtaggagtgcttgagcccaggcatttgagatcatccggggaaacacagtgagactcgtatctgcaaaatataaaaaaaagtaactgggttcagtggtgggcacctgtagtcccagctactgaggtgggaagatcacttgagcccaggagatcgaggctgcagtgagccacgatcatgccactgcactccagcctgggtgacagagcgagaacctgtcttaaaaaaaagaataaatatttgctgaatgaatgcatgaataaatgaatgaataacggcacacattacatcgtattgtgacggtttgttccttgaggacaggaattgcatcttactcaagttcacatgtcaccacccacttcccagactagcagactttatgtcttagtgaacactcactgaatacatgtatggaacaagttatacctttaaccaaagcttctctcttcaaagctgaaacaattgaacgaaactgtgggtgagttttatctcccagggaaagagcatacgcagaaatggccaatgtaaaggtgctctgggctggcagtgtattttcaagcagaaagttgtcagctttaattagagctgtgtcgattttctggaaacaagagaagatacttcagtttctatgtcaagcaaccacctatcaattgatatgaactaccctcagatcccactatcctggagcaagcaatatgggggtgaaaagaggactgacctaatggaaatggatggcttctcagtgaagcaaatccctccgagagaaggagcagagcataatcttggaagggacaatgaggttgtccaaatcaggttaagctttttgcctctgaattctcactttccttttagaggttttgtgcctttagtttctgagtacaccgtcagacctagcctccaggaagaaaaggcaccgagcatagacacaatttctttttttttctttttttttgagacggagtctcgctctgtcgcccaggctggagtgcagtgctgcgatctcggctcactgcaagctccgcctcccaggttcacgccattctcctgcctcagcctccggagtagctgggactacaggcgccccgccaccacgcccggctaattttttttttttgtatttttggtagagacggggtttcaccgtgttcgccaggatggtctcaatctcctgaccttgtgatccgcccgcctcggcctcccaagtgctgggattacaggcgtgagccactgcacccggcccatagacacaacttttattgttccctctcagcgtagttgcaacaggcacacaggttcaaaaggagttacacttaaaaaaataaataaataaaacaataagtagcagaaagaaaccctaactgccacagtacttttagatcctaagaatgcctgggtaaatagtcccgatcactagtcctgacgccaccaaaatggttgtgttgggcaagtgggccagcagaaagcctgctgcgatgctgctaacatcctgcctgcctcctctcccagctccacatgcatctctcacccatgtggccactaggtgcctgggaactagtcttcattgattattttgtcttgttaagcttctgaaacaaactgaaaacaaatggttttgttttgtgcttccagttttgcaaatccacttgagattttccatctcaaccttggaaatcttctatgttgatttacttaggtggctcatcacttttctcccgtttccaagcaaatgttgtttggaaggatttggaggatacacatttgctgttgtgtatcctcagtacttgcatgatacagaatgctttcactataggataacagtaacatataaagcaggatttagcaaagataagacagagaagctgggggcactggatcattcttccatcccagtcccagctatcagttttagacccagctctacaatttattagcctgtgacactgggaaactgaattcaccttacttagtcctcagctttctcaactgccgatgagtaggttggactaggtggtctctaatatctatcattgttctgaaatctttcaattctggagtttaagttattttcaagttattggaaagaaggaaaagaagcttttgaaacaaaaggtcttctgattggtggcccctccagtatatagtacagaaatagatgatgggtgtgagagaaagaaaactcttacttaccaccagggggcatatatcgaaagcctttctaattccaatcacagtaaaggctgtaagatataagctgttctctcgggcttcaacaggcaaggtaccctaaaaagaagcaatgttttaaaaggggagtgaaatggtgtctttaaggcgaaatgacctgattctactctgttttttgtttgtttgtttgagatggagtctcactctgtcacccaagctggagtgcaatggcttgatcttggctcactgcaacctccgcctcccgggttcaagccatcctccggcctcagccttctgagtagctggtactacaggcgtgcactaccacgcacggctaatttttgtatttttagtagagacggggtttcaccatattgaccaggctggttttgaactcctgacctcatgatccgcccgccttggcctcccaaagtgctgcaattacaggcgtgagccaccgcacctggcctctactctgtgttttaagccttatctcccactctttcccttcctgcttcccatttctcaataagccctgggtctatctcgcttgagtgctttcacttgcccatctacctccaccccgttaaacgagaggtctaagatatcacttctctgatctctagtgaactgtctgaagatcgcttcacttcagatattatgggaaagacctttgtatattttgcttgttcacaaaggaatttcttgcagaattacatttttttcttcttcttcttcatcctcccataatcagatgagaataaaactcaaactaaataaaactattgctaatttgtgcatttggtttccttacctgtaattttattggttgatactgtgaattttccttgaaagatccattatctaattgataattctcaactagccacaataaagaattacaaattgaattttggttctgctctacgtatttatttacttgtccaagtactcttaaagcaaaagctgttaacctttaagacaaaatcaaataaataaatatttagaacgctgaatcccttttgactttcaattaatttatacaactttattctttaaaagaaaataacattttaaaacatgcaattccaaagtaagtcatcattttacaaaggaagggaagatttttggaatacctccaaaacattcggtaaacaaatgtgaacagcacatcttctgtgattacaacattgtccgctagcacacaagctaaaaattgattcctgatgataagaattacactctaaagttaaagataacagagataaaataaatagttttgagtcaaggcattgacctatgaacatgagacatgaaagagtaaatcacaaaattctagattgtaaaatttgtgcattccatggaatctaaattcctatctgaggccccaagtcccctttcccaatgtccctggagtgtttatctcacttgtccttgagtgctgccattgacacagaacttactaccccacaggaaattttaatgatcattattacttagtcaaaaagcaatttcaagtctctactaatacccatcgaagagtatcagagaggattgggttcatccccccataacatctcttcactctctcagtcgcccaggaggctccactccccaggtcctcaaatgtctgagactcagaccacttgacttgctctcccacttcccccacttaaaaaatttgtgtttctttttcattttcattttttaaatgtattttaagcatttttttaaagaggtaaaaccctcacatgattcaaaaatccaaaagtgaagcctgggcgtcatagtgagacattgtctctacaaaaaatgcaaaacattagccagatgtggtggcaggcacctatagtctcagctacttggaaggctgaggtgggagaattgcttgagcccaggaggtagaggctgcagtaagctgagatcctgccactgcatccagcctgagtgagagaacttaaaaaaaaaaaaatccaaaagcacaaagggatattttatgaaaagtctccttctagcagtccctgtccccctccacctcccaacagaagatgaccattgtttcttgtgctttcttccaaatagtagatacaagatatagccttcccatctacctttccatcccaaccacaccaaaatggtgggagaatgtttacattatcctgtacttggctttttttccatttagtaatatgccttagagatctatattaatacataaagtttccttgttcttttacaagtgattttatacattaaattatagtattttggtacagatgcaccaaagctatttaagccatttccctttctgtagacatttaggttgttctcagtctttgctctaattgatttaattattttaaagattttttttttgatattaatcggaacttgcccctccacaactaggtgccttttcctaattctttctctagaaacatcagaaatttattttctactctattgacttttagggggtaagagttgagagctcctctctttttaatcctcccacactgctctcaaggatgagaaatacttctacggattgctcaggttcaaggacactcacattttcaaagattggcccacattttacattgggtctctcttgggattttggcttttggaagtctctcttcttttagcaggctagaaaggcatatgagtgcagttatacggccaggctgcctctccacttatctatacatctgtatatataaagatgctttagttacatctttgaaaaaaggcaatggcaataaatagaaacaacggactcatcctttgggatcaattataaagattaaatatatgaacatacttaaaatagttctggattatagtaagtattcaataggtataagctcttactttttttttttttttttttttttttcagacggactctctctctgttgcccaggctggagtgcaatggcgcaatcttggctcactacagcttccacctcccaggttcaagcgattctcctgcctcagcctcctgagtaggtgggactacaggcacgtgccaccatgccaagctaatttttgtatttttagtagagacagggtttcaccatgttggccaggctggtctcaaactcctgacctcaggtgatccacccgcctcagcctcccaaagtgctgggattataggtgtgagccactgcacctggtttttataagctcttactcctatctctctttctctttggtactcttgggtgtctcatccctggtatccttaaggagtgagagtctagacagcacttccctaaaggtaaagcaaatacaattcgctctagctttttgcgttctcctcttcccactgacctgtcccttggagactgccctgaaattcaaattttaagtgtgacatggaggaaaaaaagaagtaggctatttgatttgcttttgttccagaccctaggctacctctacaagtgcttaatatggtctagtttagttcctcatgttttacagtagggtctgggactaaaaatttagagtagaaaagaattttttagtcaccttgaagagaaatctggcaaaatctgatgaaactgtaaatatgcattccttatgttccagcaattctatctcctgggatataccctagagaaactctcacacatgtgcacaaagagacatatgaagatgttcattatcatattgtttgtaatattaaaatttggaaatggttgtccatcaagataggaatagataaagaatatatactatgtgatatatttgtaaaataaaatactgcatggcaatgaaaaggagtgagctatatttacctatactactagatctaaagtaactaaaaagtattaaaagaaaaaggtaagttacagaatgataggtatagtatgatactagttataatcatttagaaatacaaaaagggactgtaaacccatcacttcattttggaagcaaataaccattctttcttttacaatgcttaactttcttaaacagtgcttacttaagaattccaggaactagccatgagataaaaatcaaggatgtgaaatgtcccctggagaagaaaaatactgagcagttaatctacaaacctgtttcagtctagctgaccactagatggcccgttactcaagataataatcagaacaagacatgctgacctgtacgtagctaactcttgcacacagttttccaagccccttcctctttaaaatccctctggccagcctagggcatttgggatagtttcctgactctagtctgccatctccttgggttgctggctcctgaattaacctgcttttcctcccaccaaccttagtctcttgagtttggcatttgagcagtgagcagccaaactggagttaagttacagctatatgatttcatgtatatatatactatataaaatattaaaaatgttctggaaagatgcataaactcatgatagtgaatgcccttgggggaaagaaacagaaataagatggaggcttgtagttaaagagaaaagttcaatatccacaatgttctttaaaaaaaaaaaaagacgaatataaaaaatgttcatcatcatcaattttgggttttgctaatatgaatgatattcgtactttaaaaaatctgctttgtatttctcaagaaaagtttgagggtatttaggtgctggacattttcttctatgtctattatttctttcaaggaactcatggagttgggtgtatgtttcagtcttgccccaaactcttgaaaggctctgagtgtttactgagaggctgttgtaccttcctgtggggctttctgctctccaggcatctatttcccaggtcctgctgtgtcagtttccagtcttcattgacactcactcccactcctgcatcctgggttatcctctggttggtgtgctgcaggggtctatgagccttttatttatttttttatatttttattgttttattaaagacagggtctccctatgttacccagtctggtctggaactcctctgctcaagccatcctcctgcttcagcctcccaaagtgctaggattataggtgtgagccactgtatctggccctgtgtgtcttttgaagtgtgtcacccacacatggtcagacctaatcctaaggtataatctatggaacttggtagctgatcagaggtaaagccaaaaggaaaggaaggaatcaaaaaccaactgatgattctgacttgatccatgggggacaaagggcagggtattgttgtgcactgagtaaagaaacagaagtgtatttgaggaagaaaataatgaatttggcacatattgtgcttgaaggatctttggcttccggaaacctagaaatatggatctaggacatttcctaacttcttaggaaagaagttaggccttgagacattgattagggggccattggcctagatgttatggaaatcatgggcaataatgagactgtaccaggggagattacagaaaataagagggccaaagataaaattctgggagatctcaatagctaaagaaaaaaaactggccaggcgcagtggctcatgcctgtaatcccagccctttgggaggttgaggtgggtggatcacgaggtccggagatcgagaccatcctggccaacatggtgaaaccccacctctactaaaaatacaaaaattaggcatggtggtgcgcgcctgtaatcccagctctcaggaggctgagccaggagaatcgcttgaacccgggaggcggaggttgcagtgagccgagatcgtgccactgcactccagcctgggaacagagcaagactccgtctcaaaaaaaaaaaaaagaaaaaagaaaaaagaaaaaaatctaaaattaaagtattctaggttgtaaactccttaaatatgtttcatatagaacctacaaagcagctggcacaccgtttttattaaatattttgtcatagcatgatggtttttttgttttgttttgttttgttttttgagacagagtctcactctgtcacccgggctggagtgcagtagcgcgatctcggctcactgtaacccttgcctcctgggtttaagtgattctcctgcctcagcctcctgagtagctgggactacaggcacatgccactacgcccagctaatttttgtatttttcatagagacggggtttcaccatgttggccaggatggtctcgatctcttgacctcatgatccgcccgccttgtcctcccaaagtgctgggattacaggcgtgagccaccatgcccagccggtattttttgaaaatagactgccatatggactcttaattaattcagactatctttccctcaaatcatcagaattttggaagatatgtttcattgaataaatacttactgagcatctactatgtgccaggtaggtaccaggcactagggatacttagaacttcccgcatggagcttatattccagtgggggagatacacaatagtggaataagcaagaacgttagtaatcacactgaggagaaaagaaacgatatgaggtgttgggaggggagtggattgcaattttagacattatgatatagcagaggcctccccaaggtgacatttggtaaagacctgagggaaatatgagagccagtcatgctgacacctaaggaggagtattccagactgagaaaacagtgcaaaggccctgaggtggaagcatgcctggtgtgtttgaggaaggctagtggggctgaattggagggaaagagagtataggagataaagtaggagacatgaggtggagccagatcatacagagctttgtaaatcacaataaaaagtttggtttttactctgggtaagatgggaagctcctaaatggttttgagtggcatgatctaacatatgttttaacagggtcacttcagttgctgtgttgagtatatactgaagaggatcaagggctgaacccagaagactaagggagactagtgtaagaatccaggtgggagaggaaggtgtcttggaacaggatagtgtggtggaggtggtgagaagtagtcaaattaaggatatattttgaatccatatctgctggatcagatgtgaacggtaagagaaagagaggagtgaaggatgacgaggcttttagcctgagcaactggaggaatggagtttccattatggttattattctttagttaattaaccactatatgaaaatgcaactcaaaatcttctacttaccaagtgctagcacttccacccttccacacactgtaagagtagtcagcatttctgtaggacataatgctcaacatccctaagaagcacaagaaaaagaacacggtgcttaacagacctccgtttctactcaaagaacactttatcaggccctgagaatggtaagcttcctttggtgttgggcagcaagcatatgctctgtggccagcattgaacttctcaaaggaagtatatgaattgctcgaattgggaattatcaagtagaacattctgatctcattcgaaaaggaaggaagtgttctgtagtttggaatgcaggtgccttgcctctcattcaggcattttggtaagttgagccaaaatgctacagaaataatatttatttatatagtagagtccatctcatgatttttttgctaaaattctcttacaaagttttctataattcacaacttaaatattagtttaataaaaatattagtttagaatcacccaatttttatgtgaaatactttttttttttaccttcttttaattttttcttcagtttctgcttttcaattaatgggtcagaatgaaaaatgttccaatgatttcctgtttccaggtagtgaaaaacatagaatactgggacaacgctcatcagctccgcctctgcactccctttggggaggtgggttaggatattgatgccttcctgacttagaactgcagacaagatctcacctacaagcagtcctgaaacaaaaaagatcaaagtagacacattgctttttattaacttctaacagtatgttctcaagagagaagaacaaccatctagagatggttcttccctttttatctaggcagttgacttgcttctcagaaacggggtgagaaaaaaagatccggttaggaacatgaatttgaaagaaacaaaaaaaaaaaagactttaaaaatcactaaaatatggtggtaggtaatgtaatacagtggactgattgctgcaagagaacatggcaaattagttgccattcaacctgttagctttagacattataaaccatatttaccaatcccttccaggaagcaaagcaaagagcctgaacagggagtgctgacatgactgtctataattcactgtgcaaccttggacatgccactttcttttatatccaacagcagggttgcacatgatcaaaaagatcctttccagtactaacattttgtgattctagggttttatctgagataaaatgtagtcaggacattctatcattcggtaatatgttattgaattgtaaagcctggagactaaggaaaacctagtcacttgtgcaaatatcacttctgcaaatgtatgcgaggggaggagaatccctgctatggtttgaatgtatatgtctctccaaaattcatacactgaagcctaatcaccaaggtgatagtattagaaggtggggctttttgagaggtgattaggttatgatggctccaccctaatgagtgggattaataatcttatagacgaggtaagaggaagttcttcacccctttttgcccttttgcctttccactttctgccacaggaggatacagcaacatatatcctcatggaaacagagagcagcccttgccaaacacccaatctcttgatgccttgatcttggacttcccagcctccagaactgtgagaaataaatttgtattatttataaattttgttattttgttatggcagcataaatggactaagacaacccttctgggaccagtacttcagcagagcagtgctgttctcgctaggccatgtgcaggccataggccttctctggagcgggactggccactaagaccatggaaagttctttaagtctagaagcaactggacccccattttagagacatctttgagccaatgacagtccctaccttccattggaggagaatgcatctccatgtaaatcaggccgttggaagaagatagtgggaaaagtgattaaaggtttgaaagtgggggtgggtaggggtggagcactcctaaaggtagatttgtgtgtgctactgaacacggaagtggagaaacagaataatcatgaggatatttgatttttgtttgaagcaccaagtgaaatgagaaataaaaatggcatttgttaatttaccttttacactcaaaatccttttgatttctgttttggggaccaaatctaagggtatcctgtatgggaactcctttcgtctgctaatggtacctgtaatttagaaaatttggatttatacagagtttccaggggaagactgtttgcagattatttataatgtatctacttccaaagaatatttcaaaataaaagacttataattagactattaaaattttaaaagaaagttaaaaatcatcaaggactttaatcaaaccctaggcttgtataatcttattaaataaagcattaaatttggctgtaagcttcctggtcattataagatgtgaaataaataggttatataaatcttattcaccagcaaaatatagcatgccagcttgcccaaagacagaaaattgttcctggaactgaaagctaagaataactaacatgtaatttcttaatcaactatatattgaacattagctccacagggaagtatgatctgaaattctttccaccttcccttcccagtctagttttgatactttttaatctatgggcaaaacaacagagttttagcatactggtatcagataatttttctactgtgatcactggtttatgtccaaaaaaaggtaacattgatcattctactgatagagtaccaagcatgctactaagttctttaaatgaattattgcattggattctcacaacagtcctctatgttaggtctattttcattagtttaattttatagatgaggaaattgaggcttagaaagtaacgtgttcaaggtcccagaaacaatacaagtggagctgcaatctgaactccagaagttttgctgcagagcccacactagtcaccacaaagagaatccacctcccattgtcctgctaagaaagcactctgggggcaggaatcatttctcattccagctgtagtcctggcacttagcacagaccctggcatatggaagatgctaaagaaaaatgagtcacattttgcaatttaatggacaagccacatggctttcctaaaaatgcaggaacattcctcataaaacttctttcttcattaatccttgataaatgcagaggatatatcaaaataaaattcagaagacatttaagaggtttgcactttgagtgaaagagcatgaagttcaaaaagagcttagtatatatgtgacgctgggcaagatacaacctttcttagcctcaatttgttcatcagttaaatggagataacaacattttcctcaaaggatttttgtgggataaaaataatatagacaaagagcctggcatacaattcatgctcaatatatgatacttattacagatagccttgagattatctagatttgctccttcaccattttctccattgaaacctgctcttgactatttcaattccattggcaactctactaccaggtggaaaaggtaaagagaaagttaaaactaagagaagttaattttattcctcatcagtgatcacggtaaaagactcatcaagacatcacataaaaaggcaggttccagacagattaaaacattttaaattcaaatctataaaattaacagaataaaatatccagcaatgtctttgtgaactaagagtagagaaagacctcttaaagattacctcaaaaatatataaccataagatgaaattatgatggatttgactacatcagaataaataattccttttcaaacccatgaaggcttgttgttgctcaaagaggtacatcagagacaaaatcaagaagaaattttaaaaggataacccaaatagaaaatttaaaaacgtgcaaaagatatgaataggcaattgacagatgggaaacccaaatggacaagtatatgaagaaatgcttaaaatcattagtaaccagaagaatccaaattaaaacaataatgagatagtgctttatacccattaaaaatgccacattttagagaggcaagtgttggtgaggttgtggagagacgagaaccctcgtgcactgctaatggaagtataaccattctgaagggcaatatgacaggactaaatggcattaaatatgtatatatcctttgacccagctcctggatatatggtccaggtaaatgctaacatggatttttcaagggaaatatattgtatatacagtgatggataaaatggtgagggaacatgctctgaaattctatgtaagaaaaatgaattaagtatacctataacaatagagttatatatatatatatttttgagacggagtctcgctctgtcgcccaggctggagtgcagtggcgtgatcttggctcactgcaagctccgcctcccgggttcacgcccttctcctgcctcagcctcccgagtagctgggactacaggtgcccaccaccacgcctggctaattttttgtatttttagtagagacggggtttcaccgttttagccaggatggtctcgatctcctgacctcgtgatccgcccgcctcagcctcccaaagtgctgggattacaggcgtgagccaccgcgcctggccgagatatttctttaaaactaagccttgagtgtaacaacttaagacagaataggatctatagcacaatgttacatatacatagattaaagaggtacatacatacaaaacaacattacctttctattcaaaagtatacagcaaacacatttgagtgggtacacttggaggaaggggaatgggaatggggtccgggatgaaggaaaaaataaaacgagaggggcctgcctaaaccaatgaggatggtgtgtcaggaaatgagggagtgagaaacttaacactctgcatttgagatatgagacgagttgggagaaaagggcttatcagggacagaaagcagaaactaaagactagagctagtcttaagcattgagtctctgtgtttagtctttttttaagctggtgtcacacaattttaattactatatactgtttgttctccctcattgatatattttttcagatttcctttaacattatagtccatttatttttccaaacactttttagcatttttttttaactgaaccctgtaaagtatcatagttgtatagcgatttcaatatataaatatcagaaataggccgggcacagtggctcacgcctgtagtcccagcattttgggagtccaaggctggtgggtcacttgaggtaaggagttccagaccagccttgccaacatggtaaaaccccgtctctactaaaaatataaaaattggccaggcatggtggtgagtgcttgtaatcccagctattccagaggctgaggcaggagaatcgcttgaaatcaggaggtggaggttgcagtgagctgacatggcgccactgcactccagcctgggcaacagagtgagaccctgtccccccaccccacaaaaaaaaaataataaatattagaagtatttaataaaatatctgaaataagctgaacagaatttttatcttttccctctttagctctgcagaaatcaggaaagctgcctaaacccaagttgcctaaaatgttaagggaaaaaagtcatatgagaagattggaaagaggcacagatttttgttttaacccagattttctctacagagatttattcccagataaaagattgttcctatcctgtggccttgatgttcacacctaggatgagtaaggcaagactgctctggaaaattgtttgcaataatgtcagcagaagaagcatctgtggtgaaaaaaaaaaaaaaaagaaagagaagccaaggacacagtggcttttgaggcttgatataattgcatgaggctaaaacccttgaaacttgtaatatctctacccatagatcattcacaatgagcaggcaaggaggaggtctgtgtgaagaaaaaattggagaaacaagtaagcatgtggacgcatgtacatagatggattttactttttattgctctactgaaataacactcctcagttcatgatactcagatgaattaaagtgtaaagggtattaattctttgctttcccagaggaaatgacactgatgatagtgatcatgatctgtaagtaaattttttccccattgttatatcattgaaataaaacaaaaattattgatacaacgttaagataagttgtaagcatttaataagaactgcagtaatctgtcttctttagttgaaaagagaatggttaactggccacatcctaaatttcataaatacatgtatatgtatttaggccttgattaagtactcaaatgtttgcaaaattctagctttgagaagatttggaatatctcaattgaaggaaaagtagggaagcaggagcaatgaggaatgggtttgtttagtgattaattagcattattatgttttcaaataatgcatgttaattatgtaaatgactttttcttaggtgttctttggactgttggctcaataataatatattataaattattattgtgatggatagacaatgaataatatatgagggaagtcatgcaattgttactatttcaaggccttgcattcaaaattaatggaattattattgttgtgtctcagtcattcagattatagtagttgtactataatgctatcaagaaagatagtgatctaagaagtggatacttttttttttttttttttgacacagtcttgctctgtcgcccaggctggagtgcagtggcacgatctcagctcactgtaacctccacctctcaggttcaagcgattctcctgcctcagcttcccaaatagctgggactatgggtgcccaccaccatgcccagctaatttttgtatttttagtagaggtagggtttcactatgttggccaggctggtctcgaactcctgacctcaaatgatccacccacctcggcctcccaaagtgctaggattacaggcatgagccactgtgcctggccagaagtggatactactgattttagacaattcactttctgaaaaatagtgttttaagttacatacacactttaacttctaaagcaaaagataacatataaaataaaaaatcattttgcctaccataaatacccctaggatccaaagtaacaccagaatagctttcccttttgacaccttctggctaaaataaaggcagaaaacattcagttaaaaacataagtttatataacctgaattccctggatcaacttttctggaccacttttcaaactaaaaaattatttttcttggaaaaggcaaactatgtataaatacttacatggatataagcagcaataagattttatggctatttgcatattgaccagagcaaatgcttaaaaagaagttatttataagccagataattgttctaagtgctttatatgtattaactcatttaacctctaaaaacctctatgaggttggtgctgttattactcccattcgacagatgaggagactgacacacatggaaatcaagtaacactgtcacactgctaggaggtgatggagccaagattcaaggcccagcagcctcgctccagagactgcatggaaccacagtgcaaggatgcatgggaatgtgctttgcacaaaataagtcggtacatgtttactgaagtgaatttcatagctgaaaacagagagtgaagagccaggaaatccagtctgtcattaattggccatatgacccttagcaagaatcttagtcctttaaaagtactattatttttaattggtaaatcatacttatataaaatattaaaattatataaaaatattaaaattacataaaaatattaatgttaatagcgtgaatacaattaacagactgtgggtaaattgtacttaacaaattatacttttcttcttttttgggactgtttatttgtttatacaatggaaagttttctagactgcaagttctttaaattcaagggccatgtcttatttattgttttatctccagttccttgcataatgtctggcacatagatttcaagacacattttctgaatgtattaaggggaaaaaaaagcctgtgtaccaattgtacctgtataccaaaaaaagacgtgtaccaattgttaaaattagatatctctgggtatgggaattattgatgatttttatttatctgtcgtttttcagtattttatattttctacgaaacaaatattgttttattaaaaatttttaagcacgatttcagacttacagaaaaattgcaagaatagtacaaaaaaaatctggaataacctccatccagtttccttaatgcttaatgtttcgttaaatttacactattgtttctctcccccccctttctgtgtctctcttttgcaataatttaagcataagttattgaagcatgtttttcttaccaccactcgtaatgtttttactaagatttcttttccaaaccaagtctccagtgaaaaattgatgttgtgaaggccaatttccagaggaagcacagtgaatgtcaccaagtgactggaggagccctctactttctggcgcacacatttggaggactttgtgccctgatgatcaatgactgggctttccgaagtgcagattccctccacagcagacattttaacacagaactgaaatacaagtgaagaattatatcaaaatacattttttttttttgagacagagtcttgctatgtcgcccaggctggagtgcagcggcatgatctcagctcactgcaacctccgcctcccggattcaagcaattctcctgcctcagcctcctgagtagctgggattacaggcatgcgccaccacacccagctaatttttgtatttttagtagaggcacggtttctccatgttggccaggctgatctcgaactcctgatctcaggtgatccgcccacctcagcctcccaaagtactggaattacaggcatgatgctgtaatccgtgcccagactcgaaatactttatctctaaaaaagttgaccttgattatgcttgtctggacacaaactctccactttaacaatgttaaaataatcccttagattctaaggcacagaagaaagttcatttcagatttcctaacatagacacacaagttgccgtagagtttagcaatgcaaacagatgtctagaaaagtcaacactgtctcagaaacatcttacctttcttagactgttacgtactaaattgggtacagagctcatgctgttgtgatagcacttattaccctgtctctttacatgtttgtgtttcagatagtgggagccttaggctcaggtactttttcattttcatcttattcatttttgtatcttttagctcagcctctggtattcagtaaatgatgggtttcatcaaagactgaaaattccctatatcggcattcaaggccctgcccattatgtccccagcttacttttctaattttatcaacttcccatttgtaccccattttacaaccaaactctggctccagaaagacctggattcaatttttggcattcctcttattaactggtgatggaaactggttgcatgaactctctaatcctccattttctcatctttgtaatgggaataataatagtgcccactgacttctggctcaaatagtaaacatttttcatcttccctccaaattctggtgaactgatagaattgagaactatacccaaaataataaatccataaaatccagaataagtcaagcaggtaaacaaaagagagcaccagctattcaaccactaattttgaggaatttcttgaaaacagaaagttccttttccttcttaactatcttcttgggagacaaccaccagggtgggagaagccagagcaaaagactattggatcacctgcggccaatgatttccttagaacagcaggggagggtggggaaggatagatatagaagagtcatttaatacaattcagcataattgcattacaaaaactcttagtaaattgagactaaaaggaacttttgaaactgatagaaaatataaaaaaaaaagtggttctggtttcagtaatagccaaatagcttatattgggcaacctttctgtaaaaataaccacaaactctagacaagatacatattaaaacaaactacctgcagatactagagagtgggagggaaagtgacacttgggagaagggaatgacactgaataagtgtcccgctttttatagctttaccctgagggcaggtcccattggtgccttggagtggctaaaaccccagtagaacctgacatcatactggtttaggaactagaggacaaagtagggaatagttaccacagctgaatagtgaaggaactccaagttctgtgtataatccttgctcaaacctggctgacccttgacctatgcacagcacagatttctagcatccagctaaggctaaaaatactgaactgagatttcagagtctggaactgaatccagccaactgcctgctaacacacacacacacacgaaaaatcttcagaggaatgtaatagaatccagagtctttataatatttttattaataaagtagaagattcaatccaaaattactagataaaaagaaataggaaagtgtaacccacactcaggaggaaaggtaattaacaggaactaagcccaaaatatcacagatgtacttgtttcttattttgatatgatggaaatgcactgaaaatttaaagattaaataaaatatggcagtatagtgatatgcatgacactttaaaatgctgtcaagttggctgggcatggtggtgtgtgcctgtaatcccagctacttgggaggctgaggcaggagaatcgcttgaacctggcaggcggagcttgcagtgacccgagatcttcccattgcactccagcctgggcgacagggcgagactctgtctcaaaaaaaaaaaaaatgctgtcaagttatatataattgtgttattgcaaaggacatacaaaagagatggcaggctagatttggcccatggtccataaattgctgacccttgatttagttcataaagcaaaaggataaagagatgtaaaagattcaatatggcaagtcaatttcccttatattaattcataaattcaggacaatatgaaaaccctattataattttaaaaggagaattcaacaaactaattccaaagtttatctggcagagtaaatgtgtaagaataacaacatcaaaaacgtttgaaaaataagaataccagagagtacttgcctaatagttatacaatataaccacaaatctatggtactttaaatcagtgtgatactgatgtaaacaaaacagaggagagaatctataaatagatccacatatatggaaattcaatatatatgggggcaagatgacattttaaatcagttggaaaagcatgaattccttaacaaatactgctggatcatctggctatttgggattagatccttatttcagataaaaaaatctaaatgctcacaaaaaactataaaagtactatagaaaatatagaaaaaacagttctttagaaaaacattttattttaggttcggggcacatgtgcaggtctgttgtataggtaaatggcgtgtcgcagaggtttggtgtgcagattctttcatcattcaggtaataagcatagtacctaataggtcattttttgatctttacccttctctcaccctccaccctcaagcaggccctggtgtctgctgttcccttctttgtgtccatatatactcaatgtttagctcccacttataagtgagaacatgcagtattttgtagaaaaacgtttttaaaacttgcagtgagaaaagatttccaaaaacacaaaactcaaatgacataaaggaaaagatctacagattttataacatacaaattaaaaacactaataacaaagttaaagacaagtagcagattaaataccagcaacatttataatcaataaagaatttatagctctaacatacaaagtgctcctgtaaacaataataagtacatttgttgagtactcactatgggccaagtactatatttacatgaattagctcatttaatcttcaactatgaaatagatactattatcatcccatttgtcagatgaggaaactaagcaagaagaagctaggtaacttaccccagaaaaaaggaactcaatggaaagcaaaagaaaggatattaaagtagtatataggatatcatagaatacatgaaagaagaaatacaaatggccacagacaaatgaaatgaggttcaacattgctagtaatcagggtagtgaaatagaaacatcagtgacatatcacttgtgtctgtcaacttggcaaaaattttatgtgtattaacaaacaatatatagcgcggtctttcatgtttttaaatattatgtagttgtattcattgtgtatacatattattctgcaatttgcttttttcagcaatgttacatttttgagctttaatcaaaatgatgcatgtagttatctagtccattcatttcaatttctgtataagtgttcattgtatgaataaaagaaaaaatgtttattcccccaaattataagaatgtgagggatcaaggctacctgcatacacttggtaagaatgtcaattgatggaatccttttggaagataattatggcaatatttattatcagaaggtaaaatgtccatgccctttagcccagttagttcactccaagacaaaacatctatcctacagaaatatacatgtaggaagatatgtatgcataaatgcagactttgcaaaatcagttataatagtgaaaacctgtaaacaacccaaatgtctttaatagaaacatggttcaataaattatagtatacccaccatgtgaattactgtgcagccattaaagtaatgaagtaaatctgtatatactgatatgaaaggatgtctctgataatattattggtggaaacacaaattgctgaggcagtgtgtgtatatatatatatatgtatgtatatatgtatagatatgtacatatatgtatatatgtagatatgtacatatacgtatatatgtatatatacgtatatatatatatgtatatatgtatatgtatatatatgtatatatgtatatatatgtatatatacgtatatatgtatatatgtatatatatatgtgtgtgtatatatatatatatatatatatatacacacatacctacacaagccgattttatatgtctaagactaggtgagcagaggagcccttgctgatctcaatcctacagttgagcagagtttggctgtggcctctgtgccttacccatctgttatggccacctatttatgtgtctatctcaaattacaatttacatggtttaagagtgacacctccttaatcatctaccaaaatcctttggtagccaagatcagtgtgagttataaaattatgctgagtctgttttgatgagatggtctgactgtcttagtatctcagtttccaagcctcaagcccatcttgaatcaggattttgagacatgaaaaccactacaggaacctgatggagaaatggcctttggtatctctatctgagttatgattatcttaaattcatgaagcattctgtctgcagaaaagctagtgggtttaaaagaaataatgtaaaggcaactttacagcttcttaatcaaggtccttctccaactcttcacgttgtatttagggtggtggggatggagccaaatgagggagggcaattccacagggctgaagatggtggcatgattcataggatttatgcaaaccctgtgagtaaattctaaggaagagaaatgagtaacattttgattttatttctgtaaaaataagataatactggccgggaacagtggctcatgcctgtaatttcagcactttgggaggccaaggtgggcagatcacaaggtcaggagttcgagaccagcctggaccacatggtgaaaccctgtctctactaaaaatgcaaaaattagccaggcgagctggcacatgcttgtaatcccagctactcaggaggctgaggcaggagaatcacttgaacttgggaagcggaggctgcagtgaaccgagattgtgccattgcactccagcctgggtgacagagcaagactctgtctcaaaaaaagaaaaaaaaaaaagataataccatcagtatggtaaattctgattacttaagtttattccccatttacatcctgtggccaagtaaaatttgtgtgtgcattctctgatatttagtgttacctgatgaaacaagtttatatggaaaagttcatttttactgaaaattaaaattgtgaaaaaaagagtgacatttcttaacatgatttggattgaaaaatgaaattggcatttctatgacaaagagtaagtctgattttcgctgatcattttatcaatgaggactgatttttccagttagattatatgacaaacatattacataaattgaataagctaaatgtgaagctccaagatataagattaaaatatattgataaaggggtaataaaattgacaatatttttattttatcaaccttcctgataaaattgggttgaacagcaatgcctacctctataaaaatgaaaaataagaatagaatttatgccaaactctctctcatttctaacaataaataacatttatccataactattaagccaattgagagaaaaatttcatttatctaatgagaagataattttttttttgagacggagtgtcgctctgtcgcccaggctggagtgtagtggcgcaatctcggctcactgcaagctccgcctcccgggttcacgccattctccggcctctgtctcccgagtagctgggactacaggcgcctgccaccaagcctggctaacttttttgtatttttagtagagatggggtttcaccgtgtttgccaggatggtgtcgatcgcctgacctcgtgatccacccgcctcggcctcccaaagtgctgagattataggcctgagccaccgctcctggccgagaagagaatttttaaataaaattttatttctatatttaataactttagaaatatgttattttatcaatagtatactaataataatatttgtaatgatacctaaatccacatatcatttgatacttggaattttacaatcatgaaattttaagatatttcattttcaatgtatgtgcatatttttgttcattaaagtataataaggtgatcaacagaaaaaaattcatgcataaaatatgtaacattaggggagtaaaatggaaatatgaattcattgaggaaaaggaatgatatgtaatctgttgctaagagcttattcgagcccaggagcagttcctcatgcttgtaatcccagtactttgggaagctgaggcaggtgggtcacttgaggtcaggagttcgagaccagcctggccaacatggcgaaacctgtctctactaaaaatacaaaaattagccaagcatggtggcgtgtacctgtaatcctagctactcaggaggctgagtcatgagaattgcttgaacaggggaggaggagtttgcagtgagcggagatcgcaccactgcactccagcctgggcaatagaacaagaccccatcttgaaaaaaaaaggcttatttgagcatttaaaaaattgattgctatggtatttggagtctgctatacataagtttgataaaacagttttattttaagataccaatatttaaatattttaaaagtaatagattgccatcttttaaaaaatgtatgataaaaattttagatgccaattttaaaatgtgtcagagggcagagcgagactccgtcttaaaaaaaaaagtgtcagagggatacatagtttttccaaaacaagagggtatgtaagcaaaattttaggaaaccactgaaattctaatctctaagaataaagttagtgttttaaaaaaatatagctagaattttggaacacattgaattctcatgcaaagttttgtgactgtgattttcaaatcaaatcagtcagcctattatataattctctttaggggtgtgctggcaaagagaagataaatggtgggtccaatcatggttggaattgtgtcctggagtgagataggatccagggagttggcataattttagtcagtgtggttttaatgatggctggtgaattctaatctgaacaaggagtaaagtaaaaagagcagggaagtaaaggacaataaaagggattgagtcaatggactgaaggtttcagtgatgctactgacccagagctatggaagtaatctggttaatgagttaggaggacaggaaggaggttgtcactggatggtgagatgtgaatgtctgaaatcaagatttcagagaggatgataagatctataaagtgaagatgagtatgaatggctaaaatggaggaaagggttgttagaatcaaggaaatcaaggaactctgagtataggcaaataaaggaactaaagatgaattcacccttctctggacttccacagcacatggattatcttatgcaatttattctttcaattgaagttacatgaatacctacttgtccttcctccttccttcatccctttaattcacatccctacacatatagtacaatgctcattttaagtgtttggtttctattgctgaactgagttgaacttctacttttttgtgtatggtaattccactaatagaattctcagaaaaccagagaatgtttcctttatcccataaatattaacacctacttacctgcatcccagaagtcctatagttgtaaacagttcctttcaattggatctgttctcctcgtacaacagaatatggtatattcatttccaggaagacatctttgaacacctttgccttgacagtatcagcaacacatataccttcagcccaaagtggaagcaaagtagaatcatattaggaaattcctataatgttttattggtattaaaatttctcacatttgctttacttcaaggaaaaaataatattagatcatgtttttctctgaactctcaactcatgtccttgaattttctattcattgatcttaatttcaataataattagtattaacaaaaaacttcatttattcaacaaatagttaattctatttaaggcatgagaatgtttatcaactaacacaccaaatctttttagatattcattattggctccatgtttaatgagtataaaattttgattgtggaaaccaagattttaaaacaaaagtagcaaacaaacaaacaaaaccattcctgaagctatttggaaagcatctgcacttaatcatcataaagatcagcccaagagagttcatttatttgtttctaactctacacaagctcccagtcagtgagaaaagtgaaggaaaataaagacttgaggctgggtgcagtggctcaagctgtaatcccagcactttggaaggtggaggtgggaaggttgcttgaaactaggagtttgagaccagcttggacaacatagcgagaccccttcttcatttacaaaaaaaggaaaaagaaaaaaaagagaggagtgaaaggagaaatcaatatgttcaaagatgtgggtatatccaagtcttttggtaatacataaaaaaaagaatattttttaaaaattgctaccatttaagtcctgggtaaactaaatagatactaacaaagaattacatcttgctaatcaaatcactatttaaatgcatatatcacttaaacctgcttaccagtgtttgaaatgccaacgccttgaatttcccaggtggttagagaatcaggtagggcaaactgcaactgttttctggaagttaaaatgttgatattcaaatacagtggaatattgattaacccaacttaacagagacatccattaacagaatttttgcttcaaactactttagagaaagaaaaaaattcacgagatgaaatcacatcattaaggaaaacctcatcaagaaaaatatattcagtaactctcttatatattgcatgtttttagacattgcacctctatgatgagaattcaagttcagaagaatgcctttgaaacattgcaaaatccaagcacacaaacaaagaaaaagatgtttgttgtgagtatattctaaaatagggaagcaaagtgatgcatgttagcactgctcaaaacaaagttgacataactaaaaactgctgattatgattaagcttgtatatttatttacagctattgtctaccaactttgtatcaggtatagtgctgagtactgagtaaacagcactgataagatacagtcctgctctcaggcagtttacaatctagtggaagaaatagttaagtaaataaattacactgcactgtaataattgtaccaataaggcattataagagttcagaggcagtgtgctttcgttcaacacatttattttcagtatcctaggccaagtcctggatataaaacagtaatctgaatttagttcatgcctttgaggtatttacattttaatgtggaagacaggaaagtaaacaagtcattataatacaatatgatacacacaacagggttaattgagggtgcaattaatccaatcactggtagtgtggggagcagtggccagaaggtttactagaggacatgctagctaatgggtaatgtcagatgaaatggacaattgtgtggaagaaggattagagaagacaagggtagaaataaggagatgcgtgaggagacaactgcaggcctttgaactcattccttgccttctcattggaaaaccagtgctttaagcccatctaagaagagtatggctcgaggactcagcccatcactgttttcagtggtatagaggaagtgtttccttaaaatgtgttgaatagaaaactttaaaaagaaaacttttcttcctgtttattaatgtttgttttatagtacagatattttaggataaaaatagtggcttaatatagtgtatcgcacatagttgtgtgtagtaaatgcataatgaagtcaaataaaattaaatggaatagcacccttcttcattctgacctggagccaatcaccagtacgatgtatattaaaaaaataaaaatttaaaaaagcaaagcaaaacaaaacaaaatttgatcaaattgcaggatcatcttaactcctatgcaagctattgggaaatgggtagtttctagatttttggccataatacttgcattatccacatttctttcaaggaaacatgaaagaagtataataccttctgggaacaagatgaacttcccacaaccagctttctggaaaataactccgaatttctggcttgcttactggtaacagggtcttcatgtctggacaaaaaaatcatattcaattatggaaaaacaatataaattctacttataggtgaattttaaaatatggccattaatctgtaacttaagcattttctgaaaggtaaataaaacattttgtttaatgcttccaaaatagaattataggcagggtgcagtggctcatgcctgtaatcccagcactttgggaggccgaggtgggcagatcacctgaggtcaggaattcgagatcagcctggccaacatgttgaaaccccgtctctactaaaaacacaaaaattagctgggcatggtggcgggtgtctatagtcccagctactcaggaggctgaggcacaagaatcacttgaacctgggaggtagaggttgcagtgagccgagattgcaccactgcactccagcctgggtaacagagagagactctgtcacaaacaaacaaacaaacaaacaaacaaactataaaggccttaggatttttccactaatagcattggcaaaacaaagcattaaatatctttaatgatttttttcttaaattgctaaatgtttagtattcctgagattatacaagatatcgatcagtctataaagttatttgcacttatatatataattgtaataattgtgtttatattagaaaaaaggaggctttatatggttctctgccttctttaacttggtaatttgtttatatttactttaataaaaatggactgaacttctgttttcatataagatgccttaatagaaaacaaaacatgatatgcaaaataacagttttcagacattagagcataagcaagactgtgatctctaagagaaaggaaacaattaggtgaaacctaaaattgccccagcttactgcctagaggcagtttacagactagggcagggagaggaatacaagcagagcctgatgattttgaagacttgtggcaacactgatgggagttttgcaaggccaacttgtctggaatgagggagagttccaggaaggagggggctgcagagagagacttctatccagctgaagccaagccagatgattatagttgaaaaattgaaaaacgaaaaaatatatgagaggggagagcaagatggctgaatagaagcctacaccatttgtctttcctgttggtacactaaattttaacaactaactacacacaaaaagcaccatcaagagaaccgaaaatcaggtgagcaatcacagtacctggttttgactttacatcactgaaagagacattgaagagggcaggaaagatagtcttgaagcaccaatgccactcctcccacatcccctagcagtgactgtgcagcatggagaatctctgtgttgggagagggagagtgcagtcattctgtggctttgcattgaactcagtgttgcactgtcacggtggaaagcagaaccaggctgtactcagctggtgtctgcccatggagggagcatttggactggccctagccagaggggcatcgctcatcccagtggttggagcttgagttccagcaagcctccccaccatgggctggagtgctctagggccctaggttaacttgaggggcagtctaggccacaaggactgcaatttctaggcaagtcctagtgcactggaagtcctagccagaacaattagacaagagaaggaaataaaggtcatccaaactagaaagcaagaagtcaagttatccttgtatgcaaatgatatgatcacatatttggaaaaacctgaggactccaccaaaaaactattagaactgctaaatgaattcaataaagttgcaggatataaaatcaacatacaaaaatcagtagcatttctatatgtcaataatgaacaatgtgaaaaagaaatttaaaaagtaataccatttacaatagccacaaataaaattaaatacctaggaattaaattaaccaaagaagtaaaagatttctacaatgaaaactataaaacaccaatgaaagaaattcaagaggacactcaaaaaaatggaaagttattccatattcatggattggaagaatcaatattgttaaaacgccttaatacccaaagcaatctactgattcaatgcaatctctatgaaaacaccaataacattctttgcagaaatagaaaaaaaatcctaaaattcatatggaactacaaaagaccagaatagccaaagcaatcccgagcaaaaagaaaaaaactggaggaatcacattacctgacttcaaattatactatagtataattcaaaacagcatggtagtggcataaaagcagacatatagacctatggaacagaatagaaaacccagacaaatccacacacctatagtgaacgcatttttgacaaaggtgccaagaacatacattggaggaaggacagtctcttcaattaatggtgctgggaaaactggttatcccattcatgcagaagaatgaaacgtgacccttatctcttgccatatacaaaactcaaataaaaattgattaaagatttaactctaagacctctaactataaaactgctataggaaaacactgggaaaactctctaggacattggtctgggcaaaagtttcttgagtaataccccactacacagacaaccaaagccaaaatggacaaatgggatcacatcaagttaaagagcttctgtacagcaaaggaatcaataaagtaagcagacaacctacagaatgggagaaaatacttgcagctacccatctgacaagagattaataacaagaatatataaggagttcaaacaactctacaggaaaaaatgtaataatcccacttaaaaatgggcaaaagatttgaatagacatttctctaaagaagacatacaaatggcaaaaaagcatgtgaaaaggtgctcaacatcagtaatcaccagagaaatgcaatcaaagctacaatgaaatatcatctcatctcagttaaaatggcttttattcaaaagacaggcaataacaaatgctggaggggatgtggagaaaagggaactcttgtacactgttagtggggaatgtaaattactatacactatggagaacagtttggaggttccttaaaaaacaaagaatagagctaccatatgatctggcaatcccactgctgggtatatacccaaaagaaagaaaatcagtacatcgaagagatatctgcacgcccatgtttgttgctgcactgttaaaaatagtcaggatttggaagcaacctaaatgtccatcaacagataaatggataaagaaaatgtggtgcatatacacaatggagtactactcagccatgaaaagaatgagatcctgtcatttgcaacaatatggatggaactggaggtcattatgttaagtgaaataagtcaggcacagaaagacaaaattcacatgttctcacttatttgtgggtgctaaaaatcaaaacaatttaacttatggagatatagagtagaaggctgggaagggtagtaggaggatgagggggatgtggggatggtttatgggtacaaaaaatagaaagaatgaataagacttagtacttgacagcacaacagggtgactacagtcaataataatttaattgtacatttaaaaataactaaaagagtataattggattgtttataaaacaaaggagaaatacctcaggggatagataccccattttccatgatatgattgttacttattgcattcctgtatcaaagtatctcgtgtaccccgtaaatactatttacccacataaatttaaaaattaaaaaaaattaagagaaaaaaaagccaaatcctccctccaaaaagaaaaacaacatatggactagactgtttattaaaattctgcttataataagcaaatattattagccaggcatggtggcaggtgcatgtaatcccagctacttgggaggctgaggcaggagaattgcttgaacccgggaggcggaggttgcagtgagctgagactgcgccattgcactccagcctgggcaacaaaaacaaaactctgtctctcaaacaaacaaacaaacaaagcaaaacaaatattggaaaacaatctgaatcttagacactgtacatctcaatgaatatatttctacaaacataaattttgtggccatttaccaaaattatggttattagatattgcttaacaatagggctatgttctgagaaatatgttgttagatgattttgttgtgtaaccatcatggagcgtacttacactaatctagatggtataacttactacagatctagactatatagtatagcctatttctcctaggctacaaacctgtacagcatgttactgaacagaatactgcagacaactgtaatgcaatgataagtatttgtgtatctaagcatatctaaacacaggaaaggtacagaaaaaatacggtattataatcctataggatcaccgttgcacatgtggtccatcattgatgaaaatgtcattacgcagcacacataagtataaaacagaagctgtcattttgcttttgcttgttttgttaaagactatacataggctgggcacagtggctcacgcctgtaatctcagcactttgggaggccgaggtggacggatcacctgaggtcaggagttcaagaccagcctggccaatatggtgaaaccctgtccctactaaaaatacaaaaattaaccaggtgtggtggcaggcgcctttaatcccagttactcaggaggctgaggcaggagaatcgcttgaacccagaggcagaggttgcagtaagccaagattgcaccactgcactccagcctgggtgacagagccagattcctactgaaaaaaaaaaaaaaaaagactatatataaagtcctaaaagttctgaaaacatgttaatgagagttctataaattctggaaacatgtattgtggttgaaactgaaataagacatcagcttttatataagtacacttaaccttaggctagatttagaaatattctgctttatttcatcaatgtagatatagacagaatttttaatggttgtaatatcacaaaagcgtagacttgtagaactcacaggcatattggagaggatctggtcgaagctccttgcatgaggctcagagaggataaataatcattcaagtttatgggatgacttggctttaaggttatgccaggtcttaactctggcctagtgtactctgctctgtactgtacctcttcggatgcccaaaaatgaaggatttttttttcttatggacatttacaagttatcttttctactttcaattctaaatagatcatgaaaactgcctttcttagcagcataaaattacacaaaattccccatattgagcagaattctgatagaaaatgtcatacttacgtagccttcccaattgcatgtctttatgagagatattagcacggagctggcttgcgacgacacaacattcagtgaaagctttgatgcatcttggccctaaactaatccgtgcagctcgctgctcacaggtttcatcattattaacgcaggctccatcgtaacaacatttcttcactactgaatgtttatatttagcagctgaaatggtaataatgcaagtgctcttgatgacgcagagtgataacatctcaggcttagaaggaatctcaagggatacctggtttctgttgctatatgatccccctacccacaatagttatggctagttgactgtccagactccccttggaactattctaagaatggggagaatgtgaccttaccaaatggtccattccagctcacactaaatggttaaagggtttcctgcaattaagctaaatactaactcttgaaactggaactttgggttctgctgaaaatatgcagaaaaatatagaaaaagaatagaaaatgttttttaagaaaataagttaaatatccaagaagccttcaaatatttgaagatggctatcatcactatacaaatatttccttcttcaagctgaatatcctatttttcaaaaacttcttatataacatggtttgtggacttcacctagtagcattatccttcattgtaagtgctcagattagtcaatgtctctcttttcatatcattagaacttagaataaaggttagaattaaaataactcatatacaaatggaagaaactattatattaccataggcatgatattagttgaactcaatttgctgactcccagtttgatattctttctacagtaacatgacgaattatcataaccatttaaataattattttaaaataattctcacaagatgtattttccaaagaacaatgctactaacagttaaatatatgaaatagaagtaatagacttctaggtatatccccaaaatagtcaaatcatggattttgtcagaataaaatggaaggatatgattttaattgccagatgaagttatcagagagaaaatatttatgacaaataaaagctaatattttggattttagagcttgaagtaataaagacctatttccttagattaaggctatggcaaatgaactactagactttatttggattaatctttctgagagagataagctagacctccatacatatctttcttttcattcattttatttcaattaggggaatttatataacatttaattttgtccagtttttgaatgatatgaccataacctttttacaatcacatgaatcttacagtacctatttcttctatcttcttttgcagcgttcttcttggcctgagaatttctttacaaggttcatctggtttttttaaaaaaagataaagaagaaggattaaaaaggagataaaatctcaaaaaaaaattccatgaaactatttaagtatttagagccttcacaagtcattccttaacaaatattgaggggctgctttggattaggaactgtgcaccatacttcttaatatgacttgttttatcttagtggagttcatgatctagtgtcatatcttttgacttattttatctgaatttggttttgaatcctgcagcctctctgatccactgattccagagaaatacctaagcatttagagtgagtgatgcttttgttgggtatgctatttttattatttgctctttgtgctatattattgcaaatataactatgaataccacagtatcaagtataattatgaacaattttaaaaccatagaaagaagatgattaaggtatggttactatccttaaagagctcctgatgcagtaggtgagcaggacttacaactacatgtaagaatgcacaatgacacaatgctgttctataacttgtaaatagatctagtccctgcaatagcctccctattaaaggaggagggaattataaattctatgtggggaagaggtctcgtagaggcgatgattcttacattgcttctccaggctaatgaaggggaaaccaattccaataaataaaggcccaaaggtgcaaaatagcataatgccactcaagaactccacttggttctgtagagcttaaacataacgtaaggcacagcagggtaagagctagttggagagagccagggcgaagatcatggaaggttttgagtactacactaaagaatttgtactttatcttgaaggccagtgaaacattttatacaggtgagttatgtagtcttggcattctaagatcagggtacagaatatttgggaagaaggataaaaatgagatctggggggcaaatgatcaatgggattttcagtaataaacatgctgagcattttaccattttcttgggagtcatctgcatttgcattagtgaggaaggtaagtccagctaggtggaacacattggcattgttgaggccaccacctgccccacagcccagatcactcttctctaagaattgaaatacctgtccagaaaggcaaaatgttgagcacattgagatgtataaatcattcctctaaagatctaaaaggtactaattgttacatggttatcacaaaccagtgaaatacacagatgatatttttcaaatgatcaaagacaaaatttcccaactttgtttctaagtttgtccttttgtatttataaatacataactattcaaagttaaatcaagaactaagtcttaaacaaatagctttgatgaggagtttcttagaaactgatatatagtgttttgtacatagaatgaatgctgcaatcaatataatgttccaaataaataaataaataggtatgaatgcatgaaggactgaattaacatagaaattaattttaagttgctttaaaagcacaactttgtgcattttggtggggaggtccctaggttctaaatggctgaagacttgtttggacaggcttattcgttctccgagtattttttaattttacagtttctcagtccttccttccttgttcaaagacattcaagcctcgaaaataatagctgaacataataagataaataggaacttatgagaattgaatgattttgagattcttctgtgctatggatttcaatgagaatttaaaaaaaatccaaatgttacctatacaggtctttcctgtgctgctactagctactataactgccatcaacaccctaccctaaacctccaaagtattctgatagtaatttttcctccatgaatgtaattgctaccatgatcatatattcttaaagtgcttacatttacatttgaaaaacaaaagaggattgacctgtgctttgggagctgacaggaggatggtttaccttcctaaaaatgagtatgttgagtagattacagaaaagcaggcctagtcttcccttagttcttcctccatatcctagcctggtggccacacttcatgcaacactgcagcgagacatgcattacttaactctttccaagggctttttggctcctctttggactccatacacagcactgtccactgctgctaatgccacccaggaatccattccagttgccatattaagagacacagtttggcctggagaatatgcatctgcatcaggagacagatgaacctaaaagttcatttgaaaaagaaaagaaaagatcatttgtatgagacaagacttttcagaagcagctaaaactttggcagcctccttcattgaaaagaaaattcaattgtgacttataatttgtggcttacctggagctggttgccacatttttcttcaatatttaaccagactgaatcagacactaattctgctgtctgttctcctgtgacgatgtaatagaccagaagtcgggatgaaggaaccatgttctgtgttactggaatgtttatactttgataagatgcatctgaaaatttctccctcgtgccaaagtggataattttgcccttggataaaatctaaaaataaacagcagcagcaacaataagtaaaaaataaacaaacaaaaacaaaacctgtgctttaggatgcagcctggagctggagcagaaattatgttaaagaaaaataaagttaggctgggcacagtggctcacacctgtaatcctagcactttgggaggccgaggtgggccgatcacttgaggccaggagttcaagaccagcctggccaacatagtgaaacaccatctctactaaaaatacaaaagttagccaggcatggtggtgcatgactgtaatcacacctactcgggaggctgaggcatgagaattactggagcccgagaggtgaagtttgcagtgagctgagatcatgccactgcactccagcctgtgcaacagagcaagactctgtctcaaaaaaaaaaaaaaaaaaaaaaaaagacataccaattttggctgggcacggtggctcacacctgtaatcccagaagtttgggaggccaaggcaggcagatcacctgaggtcaggagtttgagacctgcctggccaacatggtgaaaccctggctctactaaaaataaaaaaattagccgggcactgtggtgggcatatgtaatcccagctactcggaaggctgaggcaggagaattgcttgaacttgggaggcagaggttgcagtgagtcgaaatcatgccactgcactccagcttgggggacagagtgagactccaccaaaaagaaaggaaggaaggaaggaaggaaggaaggaaggaaggaaggcaagaaagaagggagggagggagggagggaaagaaagaaagaaggaaggaaggaaggaaagaagggagggagggagggaaagaaagaaagaaaagaaagaaagaaagaaggaaggaaggaaggaaaggaaggaaggaaggaaggaaggaaggaaggaaggaaggaaggaaggaaggaaggaagaaagagtgagttaacgtttatgggcctactatgtgccaggaactttaacatgtatttaactcctttcattctcacaatacatcaataagaggaatattattctcctcatttaagaaactgaggctcagaaactaaaagtcatactgattttaattcaaaatcacacaactagtaaattagagagctaaaatttgaacccaaaaactgttcaaagtcatcacactgtcactaaaaccccttttgtttcaccgattaaaaaaaaatagatgaataagtggagtgcatcttatttggggatttaaagccagggtttagattctaaattgaaggtttaagattaaaaaaaaaaaatcacgtgaagccaaaatgccctcagaggtcccttaaattgtccttagagaccagaactgcatacatggatttggtatctagtccataaacagtttccctttatcagtcaatatttatctatggtcctcattactgttttttcaatttcttcctcaaaaatgttgaaaagccaacagcatgtacttggcctggctgtcgaaataattcattccatttatttggtgattgtcaggaagctcttaatattttctgtaagtttttttcttggtttcaccaacaggcttcatcgatccacctctgtttaatataaatgatgcaatagggatgttgctcagctacggaattggaacaggcaagataggattcaattctcaggagaggattttgcttccccattttttgacaataaaattcacttatccgaactgggtctaggcatataatctttggccatgaaagagaacagaggcaacatgatttaatcaggttctcgctttggaataactaggctctctttggtaaaaagtgttattagaacaggagtcagagtcctcagctcaaatcaaaattttcctcttcccagctgagtaaccatcataagtcttttaacttctctgtccctcagtttcctcatctgtgaaatggtcatgaaaatcatgccctatttcaaaggttttttgagaaactgatgttcaagttagatgatgctcttgaaagtgctttgggaataaaagtataaaggataattctaatgcctctctagaggcaaaggaaaatgttccaggtgggggaataagatgtaaatccatcattatgtacttaccaagtaattatagtgagttattttgtcaatatatgggcttttgggggtaacaataatattcagatgttctcccactagcaaagccttatggttatcagtccaatcaatataaaggtaactttggctgagagatgagtatgctattgctcggtaaccttccctggcctgattttcttctggaagatctggagcatcagttttgacctgaaaagagaaatttcaaaaagacatgtatactgtgatgtaatgctttctgtaaaacatacctttcaaattattttccttgctttataaatttctaaatttcacaataacaaatgctaaaggggaaaaaaccctccattacttcagtgtttatacagctgtggtgtcaagcaactttacaaagactacagacaagaatgatgggattatgggctatggcggaaaagtctgaaatgaagagagaaagatgctccaggaataattattggtggtcttcctgaaatgtcatggtaagttgggacttctcctcgcatgggatgattacagagagatgcctaagcatttaggaaatgggggtaggagaagggaagtagtggggaggtagcactaactcttggggacaggagctatgaacgaacatctcagagactatctggcccagtttcattgtgaagtagaggcacagatgggtgcttataaatatgaggtggagaagaaatgatatcatggcagcaatatctaccctcagacagcagaagtgttattagctcatgctctggagtcaggtacacactggttcacataccagtaccaccacttattaactctggataaaattagttaatcaaaagagaggttagaagcctccatttcctgagccacacaatggcaaagataatattctaactcatcttgctaattaaatggtgtttcatgtattcttcataaagctctcagcatgatgcctagcatttagtaagtgctcaatagatgacagtgagcatatgcatgctgcagtcattggcctatgttattatgttactaagttactttgtaactatgttactatgttattgctcatattttatttgagattgggaacttaaataatatttgctgcgagagaagactattaagtgggctctaaagtagaatggtttctgtagttagaaaaaagggaggcttccatatttttgacccttttgtggcccttcaggggattaaaagtgaggggggaagagaggatattcctaacactcatgtgcactgctatacctattctgaagcttctagagtctgatatggtcttaacggtgtaagataaaacaattaactcccaaataaaaaattgatacatttatcttcctcaaggaccattcaatggattagcagattgtctctgggactaatttgtcttggatgcaaaattatggaactgttcactggactcatgtgtaaaatctgccgcatctgttctgcacactagccaaaacacatggtcaagagtacacattgtcctagaaaatacaacaggagaattcagctcacattaaactccagcaccgtcactccagatgggagattaagcacaaaggaagctactccatcatcaacacgtgttacacttttgcttggatccaagtcagatgtctcttggtttacatcaattgtttgtgcattcagtgttactgggactcctcctaccaactggtcaagcgaatctttaacctgcacctgtttgtcaaaacaatccaaatctatttcaacagctcatcacttattttaaagcacaattctgaaataattttccttcctccccaccaaagtataaattatttatgtatttttttctgaaaattttttttctgagacagagacttactacgttgcccaggttggagtgcagtggctattcacaggcacaatcatagcgcactgcaaccttgaactattggcctcaagccatcctcccacctcagcctcccaagtagctggaactatttaggcatgctccaccacacctggtttacttatgtttaatttagtaaagagaagtgtattctcagcttatagaaagatttaattctatttagttaaatcattcttgaatagattctcccataaatcaagcaaactcaaaacataaatatcattctattaagtcagtcaaggagtaggtgtgataaggtcttctgctatctaacttctgtatttctttgattggtttaggactggataaaggagaaaatgaggcaatcgcttctgggaataagtcccttgaatatgagaaacaaaaatagatacaccttttttcctttaacatctacctctcactgccatatatatatatatatacacacacaattccacacagatatagtttgttattttacttttatataaacatattttaagcttatgttctatataatattgctatatttacatattttagtatatatattatatattactgtatatgcattatatgatactttgttatatattattttctatatatagtatatatatgtaagaacctacaagcatgtccaaaccttgctttgggcttggtaaatccttttttttcttaaaagcccatgacccacagtaaataataaataacacattttgattgtacttaagttgattttaaaaagtaacacattttcaaagaacaaaaaaaaattttgctctggatttctaaattaagggcagggaataaacatttccatttaatcaacataataaaatatattatttgtaataaaatatataatgatagataaaaatctaaaaaccacatgaatgtttcaattctatactgtcagcatttagaggaggaaaagaaggtgaaagagagaaaaatgaatgcagaggagtaagcaaaaaagacagaaaaaaagagattcagggacggaaagaagcaaaaatgaaaagaacagagagcaatacagagacgagagattgaacagagttatgcacaaagacaacacagagacagagggaaacaaatgagacacactggaggcaaaaacatagtgagagaaaggagtctattttcaaggaatgatatctccatcttaaggctttttaagaatttgccaccaaataattttaaatgtttgtatttttgaactagagtcttatgagattttatttacatataatttaatgcttatttattacatgtaatttaatgcttatttagggatgcctaatacaaggctatcttgccctcacttttgaagtcattgccaaggctgcagctgaccttcaatttcccatccctgtctgtgtccaccaggaggggcaggtttcacagaataagctccctctgtgacttcatggcaacattcttaccctgtttgccacccacatgttttccatgaacagaacaagatgatcatatgtagcaacgtctaccccctcacccaatctaccttgatgggatatggaatcccaggcttcaggaaaagaggagtagcaaccaaattcagtttgtagggagagaggacatatttgatgccaggtatttctgcctcttcagaaaatccacctaaggaaatggcaagcatcatgttgacagtttttaggagtatcatgatctgtatggatatccatttcatctctatatgtctccacagacttattcattcactcactccattcttgcattcattcatttaccagtagtaagtaggacataggtcttgcttcagaggggcacagcagagaagagtttagacctcaggagtttccaaggccttatgcacaagctcgtatgtagagaagcccttggagaagtagagctacaggactggactgaggaaggatgccaggaagggacaccacttttcatcagtggcctgagtttcagttgactgtattcaagggattgaggagagagggaagggtcaggccagaaactgagccttacagaagtggaggtgggggatgggggttggtgttcacagagcatagatacatagagagaaatcagaaaaagggagcttgatatagaaagaaccctgaaagggagttcgagaccagccgggccaacatggtgaaacctcatccctactaaaactaaaaaacgaaaacaaaaaaagtgccaggcatggtggtatatgcctgtaatctcagctactcgggaggctgaggcaggagaattgcttgaacccaggaggcggaggttgcattgagctgagactgtaccactgcactccagtctgggcaacagagcaagactcgggaggggagggagggaggggaggggaggggggagggggaggggggagtgggaggggggagggggaggggagggggaggggaggggagcgggaggggggagggggaggggagggggaggggagggggaggggagggaggggagcgggaggggggagggggagggaaggggacatgaccagacaactggcaagagcccaataatgttatcctccaggtaaagattaagttaaactattaagaataacatttgaagctttaatattcccaaactcctttccaatattacatctctaatacattctatacatatcctatattttagccaaactggatgatctgctgtcctcaaagattaagcttcaccatctactcttcttcatctgccctctctctggagggtttctatttcaccctgtctagcaactctgcctcaaaaccctaattatttttcaagactgatcatcttcacaacactgttcttgcttgctcaacaatcatctagaagctcaccttcctctgaatcctattgcattaatattttgcttagagctcatatggaattctttcttgcaacagttctttcttcacctgtcttatacctgatgctaatttgtaagccactttagtgctggcatcatacatcattaatgtttgcaagcctgtctgtttggcaatactttaaatatctcatagatactgcttaaactgaacttatttaaaataagttgaggaaaaaataaaaagaagaaacattaaaataatgttgaaaactttaggctttaggaaacattcagtttgactccatcattatgtagactataataatgataatagtaataacttttatttgtatagtactttatcaaatagttttacacacataatcttattttggttttgattttcaccacgtgaggacactagggtgccaaatggtcaaggcagagagcctgcagaactactttggacatgaattgggtactgttttcccatttttgcagtagaagtggaggtaatagggacccaatggcttgtccaatgactaaaaagaagcagagccctactgcctttttataactatataaaagtctacttcttataattatatttaactatgaaagaaaatacaatgtgaaataattatagaaattggaaattatttatatctttaatattctgtctaaatatttttcaaaagaaagtatacacacacacacacacacacacacacacacttacctgtagactctatgactgttacagcaatataaaggtacttgttgtttaaatcttctaaactgtagtatgacagttctttgactgctgtttcagaatcaaatgtgacttgagcaattccatttatcaactttttaaaaggagaaaaaggaggagttatttcggagaagaacttataaggaaaaattaataaaatctgcttttactaacctctaaattgaaggtaaatgtcagaagaatggtttagtgtcaaaagtaaagtagataaccgagtccacgattaagcccaggatgttattttctaattatttgtatagaattatagaagtagaagggtcttgaacatcacatggtccaacaggtctttttggtaatagctgacaaacacgacttcttccaattcctgcgtcatcattcatctttataggcctctcagcgtacttccgcccttaactgagagtttgttggtttttataatatttaatttgtacttcactgcttacaaatttaaatactaattttaaaacacacaatgagtaaagggatgtggggttaagtcatattatattatttaattattaacacaacagtaaaataaactttgccttattttttcttataaaattgagcgacttgagggcaggcatttttgtcttatttagctttacatcccagtgtctagcatagaattttgcattttaaaaatgcatttaatttacatcttgaattaataagattgtagaggataaatgattgatgatgcaaaccaaatgaatacgaaaaagtgagcaaaaatgacatgaactcatatcatctgtggtataatgtaaagaatgctgaataagggaaagggaaccagcgccctaatctcagttccagcaatcattagccctaaactatggacaaataacttcatgaatatttccttgcaagaaactatgctgtctctgggcatataagggaaatgattcagactcacaaatagtttaatattgaaaatgatagataagtaaacaagccattccagtaaagaagggtttctcaacccctcagcattattgacattttgaacaggataattctttgttgtaggggcctgccctgtgcatggtaggaatttagcagcatccccggcctctccctagtaaacaccagtagcaaccacaaatgtctctggacattgccaaatgtctccttgggaataaaaaatcacccctagttgagaaccgctgcaatgaaatgtgaagaatgtgttaagaaaagaggctatacagccggggcagctaacctagtgtagaagagtcaggggaggcttcccagagaaaggctgtcaatgttgaaacttaaagaatgagaaggaattagccaggcaaagaaggggcaggaggtgacaatgggaaagagcattttcaagcagaataaatgatattgtaaagacctggaggcaagagagactttggtcagttagagaaattggagtgattaatacaaaggggagggagggaggaaagggcatgagatcagctggtaagggaggctgatgccaaggaaaatgaactttaccctaaaggcaaagggaagccaatggaggattttaagtttcaacctatctaaaatgggggattggactagatggtttttaagtaacttctcatctctcacctctggatgcatctgtaggtgtgagtgactgtgtcttaacatcttaccattgtgttttgcattgctgtttgcatcatttctttttgatcatcttttaagtcttctcttattccaaatgtgatataaacgtcagcctcagtgactactttattataaaaatatctgtcagacaatagcataaaactgttttactaacatggttacaataacaggattcagataaaatgtaacaatttgaaattacgtaaagcacttgaggcactttaaagtgtctttcatcctaagcaaaaagaacaaagctggaggcatcatgctacctgacttcaaactatactacaaggctacagtaaccaaaacagcatggtactggtaccaaaacagatatatagaccaatggaacagaacagaggcctcagaaataacaccacacatctacaaccatctgatctttgacaaacctgacaaaaacaagaaatggggaaaggattcccaatttaataaatggtgatgggaaaactggctagccatatatagaaagctgaaactggatcccttccttatatcttatacaaaaattaattcaagatggattaaagacttacatggtagacctaaaaccataaaaacgctagaagaaaacctaggcaataccattcaggacataggcatgggcaaggatttcatgactaaaacaccaaaagcaatggcaacaaaagccaaaattgacaaatgggatctaattaaactaaagagcttctgcacagtaaaagaaactaccatcagagtgaacaggcagcccacagaatggagaaaatttttgcaatctacccatctgacaaagggctaatatccagaatctacaaagaacttaaacaaatttacaagaaaaaaacaaacaaccccatcaaaaagtgggcaaaggatatgaacagatacttctcaaaagaagacatttatgcagctaacagacacatgaaaaaatgctcatcatcactggtcatcagagaaatgcaaatcaaaaccacaatgagataccatctcacaccagttagaatggcaatcattaaaaagtcaggaaacaacagatgctggagaggatgtggagaaataggaacgcttttacactgttggtgggagtgtaaactagttcaaccattgtggaagacagtgtggcaattccttaaggatctagaactagaaatacaatttgacccagtgattccattactgcgtatatacccaaaggattataaatcatgctgctataaagacacatgcacacgtatgtttactgcagcactattcacactagcaaagacttggaacccacctaaatgcccatcaatgatagactggattaagaaaatgtggcacatatacaccatggaatactatgcaggcataaaaaaggatgagttcatgtcctttgcagggacatggatgaagctggaaaccatcattctgagtgaactaccacaaggacagaaaaccaaatgccgcatgttctcactcacaggtgggaactgaacaatgaaaacacttggacacagtgcggggaacatcacactctggggcctgtcatggggtgggggacggggagggatagcattaggagaaatacctaatgtatgatgagttaataggtgcagcaaaccaacatggcacatgtatacctatgtaacaaacctgcacgttgtgtacatgtaccctagaacttaaagtataataataataaataaagtgtccttcatgcactattacatttcatcctcataaagccacattaataaagctatgtgctagatgaaaaaaattgatcttggggagatcacaagacttagaatcagggccctctcctatatgccaaattacttccttgataattttgatatcagctactctctgttttcttttatgtttttaaaaggtacgtgtccaatctcactgttatatgagatctattcataaaaaatttaaactgcatgtttccctttttagtttagaattaaagtaagaataaagtaaactttctacccagcaaataatactatagcaagagctaactttccttatttatggtttgaataaatagtccccattataggaggtcagtttctataattttctctcaagtgagccttttatgctggtttagaccaagtaataaacactctatttttcaaatcaatgctaataagagagctagcatagggtaatgtttgaggcatggactctggaagcagacaggctgtgcaacttactagctgtatgattttgagcaaattattaaacatttatgtacctcagtttttccacttgtaacatgggaatagtaacaatatcaacgcatagagttgttgtaaagattaaatgtgctaatatatgctgagtacttagaagagtaccccacacatatagttatatagattggtataactacattatattgtaattttaaaatgacctaagcttttgtgataggttgcttgcaaaactaacccccaattctctacctccccatgtatcaacgacctttgcacagttccttgtgtccacaaagtgtgggaggggtctatttcctctgggctgaccttgtaacttgctttggacaaaagaatgtgtggaagtgatggtgtgccagcaccaagcctaggctcagggggactttcatgcttccattgcctctttgagtgttgctgctgctacaagctagcctgctggatgatgagaggcacacacacttttagccccatccaactgccagacatatggacaggaccttcctagaccagccagcccccagctgacctaccaactggctgcagctacatgggtgagcccagctgacaccagcctggcccagatcagcagaacttcccagctgactcataaatgtgggagtttcaaggcactgggttttgaagtagttacgcagcattagctggctgattaaatcattaaaaaaagataggaagtgaatccttcatatctcagtcccaatattctaagttaccctagtttctaaacacatacaccaaacttagatctttggcacttttctttgtttttgctgttgaatagccaacaaagctaaactcagaatcagctaaaatcagaataagcaaatgaactaccagcatgatgtctcctttatcaattagtccccaaatcatggcacactttgataataaatcacagatctcactttgggcaactatcatcaaccagagttgagttaatttgaaaaataaaaataaaaacaacaaaaaaacaaatgttcttaccttgcttttatagtaatttcaaaattcttaaagttcttgtaaccaatgaaattatattctggctcgattgagacagaaaaatgtggcaagactgaaaataaaaacaaacaggtaatattaccattttgattagagcagactttaaagcctagcaaacagctagactttctggtatagttggacaagctgtaacatcaacacaacatccactttattatcataatcatcatcgtcatcatcgtcatcaccaacaacaatctctgcagaaccttcccactccaacaatcagaggtcaatccagaagcactttgcctatattttgattacagcatttattataggcaataggttatttcttccattagagtataggttccttgaaaacaaaaaaacttttcaattgtgacataacataatgaaatttgcatttcaagattattttggctaataccaagcaagatagcttggaagcagagacatcagttaggaggcttttgctgtagtccaggagggagagtgctgatgaattgatgagagtggctacagacagtaagaggtgggtggattctagatatacagagaaaatacaaaaacacttagaagaagggagatgggttaggattatatgttacagagagcctgtaatctttaaggttgagtttcatcataacgaatttgttttgtcactgtttttcttgttaattgttaaaatttgtgtcagtatttattcttctccatgtcattatgaatctcttgagggaataaaaaatggcttcaagcagaagaaagttaaatttgatagcagagcacacagaaatgctagtaaactactataagaaatgaaagattaaactatttacgttacttgttagtctattaatataatttatttcaaaataagaatatcttaaatattcaaatgaatatattaggaatttaggagccagaaaatagtgttggactaggggtaaggaaacctaattgttgtttttgttttgtcactaattggttttaagactcaagtaaatcatttattggttttactgggttccactcacctcatctatgactatttaagtttctcctaataataatcacaattctagaaaggatctttactagtcaagctcttcaggggactagatctcttccagctctctgatggggaacacaagtacacagaggttgttctgcttgatcagggttaaaggcatgctggaactagaatctaggcattcaactactactcctccctccaacctctagccagtacttctagccatacgtacaggctgcctcatcttcatctgggaataattttgcattaactacattattaaaaagaattattgcaaaacactaactttttatagaaaaacttttaattggctgggtgcggtggctcatgcctgtaatcccagcactttgggaggccgaggtgggtggatcacgaggtcaggagttcaagaccagcctggccaagatggtgacaccctgtctctactaaaaatacaaaaattagccggctatggtggttggtgcctgtaatcccagctacttgggatgctgaggcagagaattgcttgaacccaggaggcggaggttgcagtgagctgagatcgtgccactgcactccagcctgggcaacagagcgagactccatctcaaaaacaaaaaacaaaaagcaaagaaaaacttttacttgtcagaaattaccatattctttaacttcaaaatatgcggttccagttgttgaaaagtcctctttatatttagccttgatcgtccacataccatatctgtggaagcaaaatatttaaaattatagatgtcatcaaatgtttttaattcactcagaggagatctaataaattcctgttttaaagagggaagaatacacaaagatatataaaacctaagtaatatattttatttgtgactgatttttaagcaataaataattgagcatttttaggataatagataatagatattgtttagtaaccagtttttcatatattgtattatttttcctggtattttatcttaatacagtcattagttttgatttgaagaacttattatttctgagaatttatttaatcttggagcctaattatgctaacataatactaaaatccaaaatacagtacaaaatccataataacgtctctagaaacatataatacaagacaagcttatacagatgataaaatttacacctcacaaaaatgaatttatggttggaaacaaagcatggtttttaaaagatgaaaatgacctggctttaattaataacctttattcaaaaacatatactaggccaggtatagtggctcatgcctataatcccagcactttgggaggccaaggcaggaggatcgcttgagcccaggagttcgagaccagcccaggcaacatgatgaaaccccatctctacaaaaaaatacaaaaattagtctggtgtggtggtgcatgcttgtagtcccagctacttaggaggctgaggtgggagaattgcttgagcccgcgagatcaaggctgtggtgagctgagatcacaccactgcactccagcctgggtgacagagtgagactctgtttcaaaaaaactatgggtgtgtgtgtgtgtgtgtgtgtgtgtatgtatgtatatatgtgtgtatacacacatatatatacacacacacacacatatatatactgagcctaccttgcagattggctatgaagtccacaaatgttaatagtattataataatgattattaccatcatcatcaattcaatgaatatttatcaagggcctattatgttgaactgctggtgtgcaatacagacaaggcccaccttaaagagtttataagctagtggggaataaaaatgccagcaagcaagtaaagaaatgattatgacattgagataagtgtcatgaagaaaataaacaagatgctgagatagggagtaaaacaaagcaagagattacattacatcatgcatccaggaatagcctttttgtagtagcttctactctgggtcataacaatgaaaagaagccaggcttatgaagagccaggtgaagcccattccaagtagaggggatgacatgtgcaaaggcacggaggtaggaaagcactggacatgccagaccatggctagcacataatttgccatggggcaagtggcacaagatgaagttggagaaatgatagcagtaataaaataataggtttaattctgcactatggaacatgtagtattttcaagaatgtacacaatttttaaattatccaagttatttaaaacctccaaattcaatttaaatttttagaaaaatttcagtcagcgaattaactgagggcagaggaaaaatgaccataaaaagatgttgttctaaaattctagtgcagccatgtatagatgcacttgtcttattcattctgctctattataaatttctttctttcttttcttccctccttccttcctccctcccctccctctttctttccttccttccttccttccttcttctttctatcttagttggagttttgctcctgttgcccaacatggagtgcagtggcatgatcttggctcactttaaccctcacctcccagattcaagcgattctcctgcctcagcctcccgagtagctgggattacaggtgcctgccaccacgcctggctttttttgtatttttgatagagacggggtttcaccatgttggccaggctggtctcaaattcctgacctcaggtgatccaccgacattggcctcccaaagcgttgggattacaggcatgagccaccgcacctggcctattacaaatttcttgaaagcagggactgtggattatttattttgtatctctccctcttattgtgatttgcacataccaagaatgtgttcattgaatatttattacattgaaccctgtttaaactttttcttaaatcctttcatgtgaggccaaataatagatatagctctgagaactccttccctcttggactttgccttctggtagtttatccaggcaaaaactacagacgaccctattttatagcaaccagagcaaggaacaagaccacaccagccttttaaactgacaatctattagatactttgaggggtaggagttgatgttttttatgacaaaaaaacctgggtactattttttcctcttcccaatttttatttctatatgtaaaaagaatggctgagaagtattggaaattttttgccaagaacagagcttaagttcttgctagaacttcaaaagattttgcatatccacctatgtgacaccctttgttaacattaggtggccccctttaactggttacctgcttcttcaccaaaagttccgtatgtggttttattaacaactatttttacatacctaggattagacggaatcttgaagtcaggaaaagagataattccaatatgatcaatttcttctaccatgtcaacttctgatccttcaggatcctgtaaataaaaacaaacaccctcaaaggccagaaactacattttaaaaaatttaactgattatacaatctttgatgtacaaaatatttatagatcaaatatttgaagacaaatacccatgtcttcaaattaaatatgaaggatgaagatctgttaaatgttatagaagggaaatatggttcatttcagccatttcccttcttctttttccaatcttccccatctctcctcattatcttgaagagactcaactctcgttgtacatctaaaagatgaagtgtaacaacacgtaaaaacaacaacaaacaaacaaacaaacaaacaatgatgtttttgataaactaaatgtgaattttgttggctttataaacaccagaatctaatttttatatatgttcatttaaagctttcaaaagcaaatattctatgaattatattttttagccagatgttttataaatgtatagtatgggcatttttcagcttggtaaaactctcaaatggttaaacaaacttgacagttctcgtaaagcttccccataaacttaattttgtgtttgggttagcaaataattgaaatgaggttttgactttctttggactacacatgggggtccaattcagccttaactcaacacataaacatagcaggcaacataagtgaggcccctatctgtacaaaaaacttttttgagacagggatcttgctctgtgatccaggctggagtgcagtggtgtgatcatagctcactgcagctttgaactcacaggctcaagcaatcctcccacctcagcctcccaagtagccaggaccacaggcacatgccaccatgcccagctatttttttttttttaatttttagtagagatgaggtctctccaggttgcccaggctggtctcaatctcctgagctcaagcaatcctcccattttagcctcccaaagtgctgggattacaattacaggcatgagtcactgaccagcctacaaaaaaatgtttaaagagttagcagggtgtggtgatgggtgcctgtagtcctagctactcaggaagctgaggtgggaggatggcttgagcccaggagtttgaggctacagtgagctatgatcacaccactgcactccagccttggtgacagagcaagaccctgtcaaaaacatacaaacaaaaacaaacaaaccaacaaaaaacccaaagcaaaaaatcttagcaccatttaccatgactgaaattcacagttggattttagaggttttatttcgtaattaattgtaaaacttacagaagcctattttgaacaagaattatacttgtagctgagtatttttatggctcttcttcatcgcactatccattgtgcacaattcttctaagatcatctttctcaggtactattttgaggatacttcctctatattaactccttaaggctctgggatcagctttctcaatcttttcttcctggggcagctcttacaagagatgactgacattcatttttctgcaggttatgccatgattctgcatcacttaagttcaaccatgaagacgttggataaagagcatacatccacacccctatcattccctgatagaaaaagggcatttgagctgacattgctctccttagttctctttcagacattctatcagtcaatcagtttatttactagcttcatttttttttatttcttcttgcccccatagcttaactcacactgtttcttacatggatggtcttcactatttttaaataatttatgtcaattcctttcattaacacccaactcagggttccctttaactactccgttccagagaaggatgtgtatcacccccactctcacctctcattggtcttccctctgagctcatggtatttgtcctactgtataatttatttgttttatattttagtatggttttgttctgtagtatctatgcttttgcacctgcattctgataagtttttatttttattttttggttttttttttgagtagcagcaaaagtgctgcagcctatattgaaggaccattagtagtatacctactgttaataactgagcagttataactagttgtattattttatttcctcacaaaagtgtttggggtatgtgacacaaattagatgagatcatgggagttcaatgcacagcgtctgttacatatgtcatgtctgataaatggtgaattactgccaatctttaactcatgatttagcaagattttttgtgttagtataatagttattaaactctaagttccttaagagtaagtaccattaaatatagttcttttgcacataataaatacataatagatatatccattatgtatatcttatagttaaatgggtattcagtcaattcttagtgattggtgggtggttttttgttttttggttttttttttttttttagattttcttttttgagatggagtctcacactgtcaccaggctggagtgcagtggcacaatctcggctcactgcaagctctgcctcccgggttcaagcaattcccccacctcagcctcccgagtagctgggactacaggcgcctgccactgcaccagctaattttttgtattttagtagagatgaggtttcactatgttggccaggttagtctcgatctcctgacctcgtgatccacctgcctcggcctcccaaagtgctgggattacaggtgtgagccaccacgcccggccagtgggtgttctttaaaaaataaatcagcaagattgtacttaaatggtttagctcaaaatccttcaagttattgaaatttaatttgtatgagcctttcacatacgtgtattacagaggtatagatctatgattctatactcattgcagatgttcaataaccatttatggaacattgaatgatttagtgtagtgtgaggacagggttatgaaatgagattcttgtcctgaaaaatgaattaaagtattatttaaataaataaaatacttactatgaaagttaagacagtttctcttttggctggcttcaagtcgtcattcaacgaataaactctaacttttactgtaagaataattgatataatcaaaaactctgctaaaaacaaggatattttgattttttaaaacaaccatccttaaaagagatgaatcttactttaaaaaactcaatacacaaaagtccatatttgaaaaaaacaaaaattagtttgcagacatatacattactaaagattctcttatttaagagaatcctcagggattcctttaaagaactatttctcttagtggatttaaagtacagttcactttcttaaaatacatttacctacaatgttttgagaaaacattcacagtatgaaattaattacatctgtaattaggccattatttattaagaatttcatagtagcaaaatagtgacatcaccatatggttatagaggagcataatatattgtctcagagttgaagatcttaatggaaaattgggagcttgattcagacatacactcttccacttatgaaaacccacaaggctccaaattagctcttattgcaaaaggcagctttggattatatggttttgttctatttattgagccagatcctacacttgttcgctcattgttaaaagagcaatggcaggggctcaataactgttagttctcttccatttctttctgtcagttaatagatccctactttttaaacaaaagcatctgtttcgcttttaactcacagctgtttgagacacagtgatctaattctttccaatgacaaacttaatttctctagggtgttgctgatgctcaaatcatttcatggccaaaactttacccacaaaataaaatagaactggcaccataaacccagtatcttttaaaagatcagtattatgcaaagctctatataagaagccacattaacactggttttactaagttcacaagataaaaacaatgtgctcagtaaatgccccacctctctgctctctccttcccctcacacctgtctcccaccacaaatcctatctcctgctttttgggacacacccagtctaggcctgagtatcactgggaagctgcccaagtcagaaagtcacaaaagttaagagcacaggccctggaattaaacactttggtttcactcctgcctctgccactttttagtatgaccctgagcaggatacttaatccctctaaaccttagttaactcacttgtaaaacaggaatactagtgtgtgctcatagtgtccttgtgagaattaaataatgcaaagcttttgcatagcctgacacatactaagtaatcaataaatgtttattttattattatttctgttactactatttggctagtttttaacccagtttgtgtttaggttagaaaattaatcttgtcttcacagcgatggtacattggaggcaagatctatacaattttttgtataaaagatatggcttattggccgggtgcagtggcttacacctggaatcccagcactttgggaggccgaggtaagtggatcacttgaggccaagagttcaagcccagcctggccaacatggtgaaatcccatctctactaaatatacaaaattagccaggcatggtggcacgcgcctgaatcccacttacttgggatgctgaggctggagaatcgcttgaacctgggaggcggagattgcaatgagacaagattgcaccactgccctccagcctgggtgacagagcgagacactcactaaataaaaataaaaataaaagatgtggtttattaatttaaaaaaagtttgaatgccaggctggagtgcagtggcgcaatctcggttcactgcaaactccacctcctgggttcatgccattctcctgcctcagcctcccgagtagctgggactacaggcacccaccaccatgcctggctaattttttgtattagctcacatcccgtgtgagccaggatggtctcgatctcctgaccttgtgatccgcctgcctcggcctcccaaagtgctgggattacaggcatgagccaccgcgcccggccttgaatgccttctaatgtgccagtcattatgctacgtactgagatacagtagtgaaacaaatcagacatggacatcttttaatggtgtggaggaaagaggcaaacacaattatatgtaaaattctagggtgtgaagtgccacaaaggatatttgcctggccttatgagcatgtagaagagggagatttgaagaggtcagggaaatcagcgaaagctgcctttagaaggatctgtgatgacacgtgagggtgaagtaggagttaacaaggcaaaggaggggcaagaatgtaccatgtagaggcaacagcatgttacacaggccttaatatggatggggaaacggtgtgagaaagcatctgaaaggaggtcagtttggcttgtgtctatagagggtggggccgtagtaggtgatgaagctggggaagaaggcaggacacaggctttatgaaattgaaggattttgggcaatattctaaagtcatttatccagtaaagccttgaagcctttatcctaaagatgcttacactaaaaatccctcaagaatcttcagattaaatgtgttgatcgggacattatagctataaataacaagacgattaaaaaatacttttaagtaattatttttcttttctgtaaatatggctttgtgctattccatagataataatggaaaacactttcctagtgcttactgtgtgcttggctctatcttaagtgctttacacatactaattcagttaattctcacaactctatgaggtaagttgtattattatctctattttacaagtgaggaaagtgggagtctgagaggctgagtgattcacacagggtcatacagctcacagcagctcaagctgtgacttgaacccagacaatctgactccagagtctgcttttaaccaatttacttcactatcttgcagaaatgggccaatatttatagcaaacttctctcattttactctacgattagaatggatgaggatattacatcgtcttctttttttttctcttttttttttttttttgagacagtcttgctctgttgcccaggctggagtgcagtggcgcgatctcactgcaacctctgcctgccatgttcaagcaattctcatgcctcagcctcccgagtagctggaattacaggcgtgcaccaccacatccagctaatttttgtatttttagtggaaacagggtttcaccatgttggtcaggctggtctcaaactcctgacctcaagtgatccacccgcctgggcttcccaaagtactgggattacaggcatgagccactgtgcctggccaggtattacatcatcttacagtaaagtcctgatagagaaataatacatgaagccttttttttttttttttttttttgctgagacgaagtctcactctttcgcccaggctggagtgcagtggcttgatctcagctcactgcaacctctgccacctgggttcaagcgattctcctgcctcagcctccagagtagctgggattacaggcgcctgccacagtgcctggctaatttttgtagttttagtagagacagggtttcaccatcttggccaggctggtcttaaactcctgaccttgtgatccccccacctcggactcccaaaatgctgggattacaggcatgagacatgaagccattcttaaggaaagccttgataaccgaggaaggtcccagcctctggatattacactgcttactggacaaagactgatgacccttagttgtgggacgtgtcaacaggatccaagcaaaaaagaatccttcaatgtaggaggaggacaagagagatgatatgcttgtttctaggtatgattatgtctaaaaggacccaacctttgtgggcagagactatttccttgtataaaaagttgtctcttggagaaaaaagatgctattattctggagattttattctggccaagtagatagcaatatctccaccccctttaggcttttcctttctgagctgatcataacaaatgctcctgctgaaacggtaatggttcagtccagttccaccccactattctcatcatcaacatcaaccaacatttagcaaatatctactgtgtacaaagtttttcaacaaagtcagatggtccccacttcctttctctgtcctcctccaagaatatcattaatgaaattccatagcctctccttcccatatatacatctctaatattctatttctgatgtacttaaaagtcattgatgacgagagggagaaacgggggaatggaaggctttgcaaacacatgaatatattgggaagcattcatacttttctgtgttttacttttggttcattgggaataggtccagtcattcctattcacatgattttgattggctattctgcccttttgcctctaacagaagaaccatgaatgttaaacaatgttctaacagtaactttcttaggtagatcccctttgaaaattaatatccatatatttctgtgatctagtttatcctctgctgaaatatctgatcccctaggttagatttatttttccagtttggggattagctccagacccagtggaatttttaatgaacatggttctacaataaattatattttcccattgccaaattatatttgcaattaagtcttatatttgtttaataaattgtaacatattggaaaacaaatttttcttgttttccaaacttttacaataatttcgcatagctaattctacagcagttggtttttgtaacaacataacattttacatttttacataacattcaacattttacaattttgaaaaagcattttctacttggaaataagtgatggggcaggtaatgtaattgttggttttgtaatttatttagcactttctccataaatttaaaattaaaatgctattaaatatttgtaagtatagatgtctttgggaattgagagtcttttgagcaaattaaaaagaaaccgatctccactcaatttcaggtattaaaaagctctacaatatagtgtcaatactgtcaaatcccccacccagaggaagaaatatcttataatctacctgactggtctggagtataaacaggtttgtctgtatgaatgaagagaaatccattgtcataggttattggcattctttttgattttgaaaaatgctttgatacaacttccaaatacacataagaaactgggttttgtcctccaggcaattgttttggttgtatctggaaaagaaattgttgatggaaaaagtataataattctaaagttattaaaccattaactttctaaatacaactgtaatctcattagaacaatcagtatgtatatgtaatcatttaaaaagtgatacaggagcaagaagagtaaataaattttgcccgaagcccttcagtgtctaattacataataaaaatttagctttaagcaattgaaagtctctttggttccatgtttcctaaattttatatacatttagtgaaactactactataaaagcctttaagaaaccttcactcaattagtttgctgggttaccccatgctccccattccctttgtgaaacctcctgaccgattctctggacccttagctttttttttttgagacggagtctcacttactctgttgcccaggctggaaagcagtggtgccatctcagctcacgacaacctctgcctcccagattcaagtgattctcctgcctcagcctcccaagtagctgagattacaggtgtgcgccaccatgtccagctaacttttttttttttttttttttgtatttttaatagagacgggtttcaccatgttggccaggctggtcctgaactcctggcctcaagtgatccacctgcctcggcttcccaaagtgctgggattacaggcatcagtcaccgtgcccatgtgtccagcatctctggacccttagtattacctcacatatttctgctcccctgagttgagatgctcattttccaatttatgtttgtaattatcccctttacattcaatgatatgtaaatttaatgcatgaaaagtgataaaaaagaaaagtgtatctatgaaaaattaggctttggaaacacgggatgaaagttaattacaaaaaccaactgctgtagaattagctatgcgaaattattgtaaaagtttggaaaacaagaaaaatctataaatattctgcacccagattgctttgtaagtgcctttaagttctttctccccttttaagaaacagaaactatagaacaggctgggcacagtaacctatgcctgtaatcccagcactttgggaggccgaggcgggcggatcacctgaggtcaggagttcgagaccatcctggccaacatggtgaaacaccttctttattaaaaatgcaaaaattagccaggtgtggtggtgcacgcctgttaatcccagctacttgagaggctgaggtgggagaattgcttgaacctgggaggcgaaggctgcagtgagccgatattacaccactgtcttccagcctgggtgacagagcgagaccctgtctcaacaacaacaacaacaacaacaaaaaagaaactatagaacaaagatgatccattaaatttgtagcacgtaataaatgagatttgacactgcaatccatagacccacacttaaaagaccttggtacaacattaaacaattggcaaataaagatacatgatattgctatgataaaattaaatggttaaaatatgtattgactatgattgccccaccttaatctagtttttcagttaatcatataggtcagcactgttcagagaactttctgtgatgacagaaatattctatatctatgctgtttactatggtagccaatagctacctggggctatttgaacacttgaaatgttgctagtgcaactgagatactgcatttttaatttcagttaaatttgtttgatttaaatttaaaactaagagccacaaatacattgtatcagataaaagagtgtcttttgaaagtaacactttctttttttttttttttttttgagatggagtctcactctgttgcctaggctggagtgcagtggcgcgatcttggctcactgcaacctccgccttctgggttcaagcgattctcctgcctcagtctcccgagtagctgggattacaggcatatgccataaaagtaacacttttaataaatgaattttaattgttaacaaacctaataagtggaagaatttgttaagagatatgagcatttactgctaagaacattaaagaattcctatgtttgactagaaattttttagattagtgtttcttaaacttgagtaatatgcatagtccttttaaaggacaaaagtcatggaggaccctcagcattggctttttattatttataacataatcaaaataatttttgatacaaagatacttaaatatatacaaacttaaaacggtacaatcttatgcttatgatttttgtataattaaaaactcaaaacaaatttataaaataaattcaaaatgttacaaaatcaatataattcgaattttaagctctttattaaatttccatttttaatttctttataaagaactcactttagagaaactctggtctaaatgaactgcagagcccattttacgtctgatattctttgattttctttattaagtatcagaatttttagtaaaaataagttgcaagtatgtctctaagcaatctatactacaatatcttaataggagagttatttgatcaaggttgttctttctattaactgcaggttgtcaatgagagctattcactttagtaatcacaaattttttagtttttgaaactataattgtagaatattagagttcaatcgaatgttcaataatatccatggatttttgtgggcaatgtactacagataaaatcatactcatatttctcaatttctttctaatagtaattttcatagcaaacaagtattttcaattatctccaaatattttcacattagtacaattttattttccaataagaatgtgaaaatggacatgcattgctcaaaaagcagacataacttctgtttagaattttctgtttctgttagaattttcacttacattatcattagtgactgacatcatctaataatcccacagtggatgtaaatgattaaatctatatgttatcaatattcaaactttgtacacatttttattgagaatattctgtatatatatataaagaaaataaaggataaatacatactgttaagattgcagagttttggaatttattctctgaggataaatgaacatggcctgaggagtaactaaattttttatcaggataacttttaatagagattgttgcatcaaatgcttcagtgtatccataaacttgaatcacaatattttcagatgctccaacacggaatatttttggtgctgaaatgacatatctgttgaaaaaggaaaagataaggctcaatgtctttatatgacatattttcttttacttttgatttttttctctcacttgagagattccatttaaaatacatatatttcctcacttaaaaatgatactaataagtcaaaatgtacttgtgacccaccataacttcagcataatttccaagtagtttggaattaagacctgagaagctggaggtttagtttacatttagaaagttaaggtgatagcagcactttctcttagctactgcagccaaggaagacttttaatcatgttgaccagaacatgtaaatggggtcaatattttttgctcaatgaagaaaaaagcagtgattgaattccagctgtggcatctgctggctgagtgaccgtggtaaagtcactaagtctttctgaggctaaaataacttactgtgaaaataatcgccttctttaccaggctctggtaaagattaaataagaacatatatatgaaaaggtctagcactcttagtactcaatacatgttaagatttattaatctcactaaattagtttaaagggagtgatcttagaaatactatgttatactagtaaacggataacggaaaggatagaatatgagtgagctgggaagtgcatttggaaatggaaatagtgatgatggtcctttaagagcaaatcatcatcttcaaacaataatggtaattaagtacttgccacatatcagaggctgtatcagcactttacatacagctcttgttaatttttacaataagccaatgatgctggtactatcattattcgtactttgcaagtggtaaaaggctaacttggctaaggttatacggtttgtaagtaaatgggggaggcctttatatgagttctcagttgttatgtgtacagttgaggtcaagtttatatgttattcacaaccatagactgttctcttatttttacttttcatgtgatttatacaataatggaagtgagtctatacatgcttttgagtgatttttaaaaattattttatttaaaaacttacaaatataaactggattactaagtgtatatcacaagagtatctaatttgaatagcgagaactacatacgctattacataggaaaaaaaagtgttttaacccaaaagggcatagtgatcgactaattcaagtggcccaacaagcttggagggcacccaccaccccacctggcagaattattccaggcttctgccaacattgtgacattttaagagtctggtaaaagcaggaagtttttagtaacaatggaattaatttatcagcaattaaatcctttaaagcatctgacagttatcctgcattacaattaatttggatccacttacaggcaaattacaaaagagaggaaagaatttccagatttccaaccatcatctgaattccccttccccacatgcctagtaggagatggcagaaaatgagaggagttcagtttttatgataataagatatatttactgaaattttgccctgtgataaggcactattctgaatactttatttgtataaactcattgtgtcattacaaccactctgtgaggaactattactccaattttaaggtgaagaaactgctaattaattttcccaaggccacacatataggatttatgaattctataattcacaaattatagaattagaaatcgaacctgagcagcccgtttccagaattaacattttcaactgttgtactaaatggaatttataaagagttttgtaattagaaaaatttagggatataaagctactttaatttcagtatttatagaagctttatgtttttaagtttagtattgctttaattttgaattgtgtatggtaggggtccccaacccctgggccatggacaaataccagtccatggcttgttaggaaccaggctacacagcaggaggtgagcagtggggcaaaggagcattaccacctgagctctgcctcctgtcagatcagtggtggcattagattctcctaggagcatgaactctattgtgaaccgcacatgcgagggatctagattgcaagctccttatgagaatataatgcctgatgatctgaagtggaacagtttcattctgaaaccatccccaccccaatcctggtccatggaaacattgtcttccacaaaacctgtccctagtgccaaaatggttggggactgctggtctatgtgatggtagccgtcaagcaaaaatacatagtgtttagaagcccctaaaagaatattctggaaccaccctttataaagattttggttcttattgacttatcagtagcataatctatccatataaataatttcatagttttctttgtctttcaattgctgcagaggagcaggagcttgcagagaggcaagaatgttattttggcctctatctggaatgctctttcctcaaatatttgcatggtttgcttcctcacttccttcaggctctgtttgagtgcagcctccttaagagaacctttcctggccacattttaaaatagtgccccataattattttttaattctcatactctgctttatttttttcttcataatactacctacctgaccttacacattctttcattggttcattcattcattacttgcttctcccactagaatgcaagctctaggaattgtcttaccgtttgctatatctgcagtgcctatcatatgtttagatgctcaataaatatttgttgaatcaatcaatcaaccaattaattaaagtgattgattgccatgttgtaaatggtacactctgacttcttcagagaaagtgaggaaataatttttattaagggctagtagaaagaattcagaataagtctggacaagaatcatggaacccaggtcctagccctagttctgccaccaatttgaagtcacttaatttcagtctctctaagccttagctgctcgtctttcaaaaagaataaaggcaggatgctaaggtagttgagtgcttgtggccatgtaaaaagatcacagatcagaaatacgagggtgctaaaaaagaatgacatcctaagtatgtgtttatatataatatatttacatgtatacatttatgacaaaatgaaaaaaattgaagtgataaacaggagaccttaataaaaatcctgtttctctctctctagaactgtgacctttggtcagtcacttcccttatctggacttattctcatatataaaatgaataggtttgattagatgatctgcagttacttttcagtattaaaatatttctagatataagatcattatttttaaaacattacttaaaatgcatattatctcaataatgacactaaaaattgtgaaaagtcagctcataaatgtatggtagaagtcactacaacaacagattttcagatcacagtattagattgactcctaaataaccctggtttaactgtgtatagtctatgaaaaacacaaagaaaactaaacaccaagttaaaataagcaaaaaatgtcaagaaagtttattatctggagtttcttttgtgcttttttgaagaggaatttgaataatcacttaacgtaaattttaataaataacaattccataaaagctgtcatgttgttagctactcatcaaatcaaaatgcttccatgactttctcattcagagatgatactattcacttgctgttctcagaagtagcaagttattttcaagttaacagaatctgttaaatttaactcttcattcgtcataactaagatgcattgaaaaatgaagatagcttgttttacttacgtttgctcctgtccccaggttttccccaggaagattaaaaaacaaagtattcccaaaaggcccatggttggaggtagcaggaaaccacggatataacacttttgaggatagtctccttttaaataaactgaacttgaagaattcagataatctggttaattattaatgtcagaaaggtgaacctctaagtgggaaaactagaattggaactaaaacaccctttcatgcccaggaatacagatagggagtactttacaggaacttacacccagggaatttatttttattaatacaaataaagggaccctaaaatgggaatttggcactatgaagagtggctcaaagctagaaaccagtaagcccattgctttggcctttcttctcttgcccagggcatttgctttgatgttgcatcatctgcaagcatacatctggcaggtccactctaatactgatgaagacccacctggactcagtttcacactgaaatgattttagaaggggcctggtttagacagggctcacaagatgatctttttttggtgacctgaatggcagtgtccttggtgctgcaaatggtctgagcataacctagctctgcaaaggaggtctagggaattgttccttggtctgtctcagtctagagaacactaggtggaggaaagttgtgactggcaatgaaaacgccatgtggaggatgctgtcgtcattctctaagtattggagaatagatattctccaatatttattaaggcatataccactcgttcaaagtttgtctttattcagatatagaatatctttcttttaaagaaaacacatgttatacttttcagtgaggattttaataattttaatataagagctccagaaaaacaaagcttcctataacaattgagtctagtaattaattcacaatatactaaaattttatctttatacttttttttttttttttggagacagagtctctttctgtcgcccaggctggagtctagtggcactatcttggctcagggcaacctctgcctcccaggttcaaggcattctcctgcctcagcctcccaagtagctgggactacaggcatgtcccatcacatccagctaattttttgtatttttagtagaggtagggtttcaccgtgttggccaggctggtctcgaactcctgacctcaggtgatccacccaccttggcctcccaaagtactgggattacaggcatgagccactgtgcctggctgatttttaattaagttaatttttatgatgttttatgttcattagaatttttttatttactaccttctcttttttagtactatttttaccttaatatataatatgtactcttctttaaaataataaaacagatgtctctaaacatatttctataatgagatatttatgatatataaatgagatatttatggtcacattggcattctttgctttgaattaataaataataaaccaaaaatatttataaacactttaatgctgaattcactagggaaaaaaggagcacaaagggaaatttgatatacaaatttcactaaaggtatctcttgcatatgtcattgaaatgacaaacatttgccactattgtctgatcatctagcccatttatttcaaaagggaatctgtgaaatgattaagctgggttgcaaaagatgggtcaagttaaaacaaacagtacttttgccatcatttttgggaaatgaaatttaagagagaacaacaacactcaaatcaaggtaggtaatatttgtattttaagtgcaaataagtttgtttgcttgagctatagagtaaatactgataaccaatatttgcaagccattgtcctgtttctctggtagaaaacatttagagaatgatggatctcaaagattctcaacagaactgaagtttaacaatttatagattctaagctgtgtttagtcaaaattttttatctaccttctaaatgtggctcacagatgaacttttgaggctgggcacgctggctcacacctgtaatcccagatctttgggaggccgaggtgggtggatcacctgaggtcaagagttcaagaccagcctggccaacatggcgaaaacccgcctctactaaaaatacaaaaattagccaggcgtggtggcgggtgcctgtaatcccagctacttgggaggctgaggcaggagattcacttgaacctgggaggtggaggttgagcacagatcacgccaccgcactccagcctgagcaacagagccagactccatctcagaaaaaaaaaaaaaaaaaaaagatgattttttttctttataatttaaaatgtgacctttggtaagcctttcatttttatacaaatactgcatttctaaaagagaagaaactcagatctggcagaaagtttggtggtcacctgaccttcctgctaatgctgcctcaattgtcccctcatgattgagcccaaatgacctagcctagtgcaccaggcccctcttgagccctgcttagttctccagcctcaacattccattcttcactccggccaaggagctgaattacctgattattccctgaagtcaccttgacaccaaggtgctcctagcaggataataattttgtatctttcaaatggatattctttagttattttgtacttacttggtaaaatatgtctggacaccaattttctattaatacaaactacagaactcttttttatgtataataaaaagattttatcatgtataattttcaaaatcagacagcttacagggaggtatattaatgggttgtaaatttagagaataaaaaataagtgacattgtgtttgttattgttttcagaaattcagcccatcagattgcgaacttcaagtgcctgctggctggctagagtaagagaggtgatgtgacccatagctgccccaggtaattttcatgtgcctgttccatgtccagaggccagtggagaaacagaggcgtctcctcagaattaaattattctaaatggagacacgggaatcatacaagttttgttcaagagtggtaggctggcactaggcaggtgggttattctaagtaaaacccagtatttgtccctctgactgctttttggctcaagcccgcagtctcacgttttaatcctttaggagaaaggctctactaaaaggccaactgaaatccaaaaagaactacttcagtaactctccatgggatatagaggagaaaggcactggaggcttcggtgccagcagtttaaagactgactggagagagggcggaggtggagcaagatggctgaatagaaccccccccgagatagttctccacacaggaacaccaaatagaacaactatccacgcaagacagcaccttcataaaagccataaaatcaggtgagtgatcacagtgcctacttttaccgtaatgataaggaaagaggcattgaagatagggtgggggtaggggggaagatctccctgtattgcctataccacccctcctccaaccacaggctgcacagcaggaaagagaatccgtgtgcttggaggagagagagcaaagtgagtgtgggactttgcactggaagtcagtgctgccccgtcatggtggaacataacacaggacagaattctgcaggcgcctagaattctgacagtgcatttaggcaggccttgggacagaggagaattctgtgctccagagggagaaacccaggtcatggctagcttcaccactggctaactaaagtggtctgaggtcctgagtctatttgagtggcagtcaggacacaaggactaaagtgtgtagactaaacataaaatgctaagcacccccaacttgccccctattgactgaatgaactcccacttggccaaagagaccccagaaacatcttaaaaattgaattcctggccgtgatgggaagggaggttagacatgccttgttataccccctccctttggagtttaggcacaactgaccagcattcaagttaaaatatcataagacggacaaaacagactctgtggcaataagataccaaattataaacaagacctcaggccattcatgcaaggaatcacaccctacaaaccataaaatatcattaaatgagttttaaaagttaacctggtatagtccgggcgtggtggctcactcctgtaatcccagcactttgggaggctgaggcaggcagatcacctgaggtcaggagttcaagaccagtctggccaatatggtgaaacctcatctctactaaaaatacaaaaattagctgggtgtggtgacaggtgcctgtaatcccagctactcaggaggctgaggcagcagaattgcttgaacctgggaggcagaggttgcagtgagccaagatcgtgccattgcactccagcctgggcaacgagagcaaaacgctgcctcaaaataaataaataaataaaaataaacctgctgtaatatggtttgcttttcaacctgactctgatatagcatcacatgacagatagcagaccctgtagggaataaaaatattttacctcaaaatatatttatttgacatattttgaaatggccctgcaaagctatcttttgtgagtgagatttgcatctgtagataatctccattaatgcaaccaggccttccctttctaggcttttcccagttctggcagagttgaactgagagtctgacatctcaaaggtctgcaaagagacagacgtttgccattgattctctcggagggctgctacctatgaggattcatcaacgtaacaagaaccttggaccccacaacctcctttaactcaagcattacttactattgactttaagcctttagacaatagcttaaccctctcaaccaattgtcaactgaagaatccttaagacccacctataactactaagtccctgcttggagatgtcctgcttttttgggctgaatcaatatatactttccatgtatcgatttatgtcttcgcctgtaactcttttctcctggaaatgtataaaaccaaactataacctacctgcttcaggcatacttcctcagaacctcttaagactgttcccaagaccatgatcactcatattggctcaaaatattccactctgaaatatttcacagattttttttcctctgttagcaagtccttgggcaaggtctagtgctgtcctggtcttggaggcagtggacttagggtgcaacacagtttaacactagctgtggcagccacaggagtatgtatgtcactccttcccaaacttcaggtactgatgcttggggagagattccttctgcttggggaaagaagagagaagagcacagaggactttgtcttgcaacttgggtatcagcttagccacaatacgataaaacatcaaacagattcccgaagcccccgattccaggctttgttcctggatagtgtttctaggcccatcctgggtcagaagggaatccactgcccggttggtacggacttggtcctggcaggattcaccatctgctgactaatgtggccttgggccttgaataaacattagctgcaggcataaccaggcagtagtggctgcaggccttggtgagccccaatacagagctggtctggaaggccatgggcttcaggtatgacccagtgtaatgccagctgtggccagtagagtgtctgcatcactcctcccccagctccagttagccaagcctggagagagatgccttctgatttgggaaagagagggaagagagaaagagactttgcctggtaacccagggaattctcccctatcttcccaagtcttagatacaccaaggctgtgtacctaagagtctgtaagagtttcagtgttcctgggcttagggcacccccaagtgctgagatggctgcagtaaccacaggcttaggccacaaaactcaatcccctttgaattcttggaaaaccttctcaaggacagggacaaacaagcctggactataaagatgggaataaatacctaaatcttcaaggcccagacatggacgaatatccacaattatcaagaacatccaggaaaacatggcctcactgaatggactgaataaggcaccattgaccgatcctggagtgttgaagatatatgactaatcagacagggaattcaaaatagctgccttgatgaacttcaatgaacttcaagacaacagtgaagaaattcagaattctatcagataaatttaacaaagagattgaaattttttaaatcaaatggaaattctggagctggctaaaatatagattactaagacaaagaagtgtatggctacatttcttcccccaatatttgtgactacgtattattttatcaataaaatatgaaaatttcttttaaaaaatcttggagatagaaaattcaattgataaactgaaaaatgcactggagtctctcaatagcagacttgatcaagcaaaataaagaatttgtgaagacaggctatatgaaaatacacagaggagaaaaaggaaaaaactaaaaagaaaaaagaatgaagcatgcctacaagatctagaaaatagcctcaaaagagcaaatttaagagttactagccttaaaggggatgtagagagagagagagaaaaattgggatagaatgtttattcaaggaaatgataacagacaactttccaaacctagagaaagatatgaatatctaggtacaaaaaaatcaaagaatgccgagcagattcaacccaaataagactacttcaagacatataataataaaactctcaatgatcaaggataaagaaaggatcttaaaagcagcaagagaaaagaaacaagtaacataaaggagctctaatacatctggcaacagatttcttagcagaaactttacaggcttgtgggatgacatagtcaaagtgctgaggaaaagaaacatccaacctagaatattatatccagcacaattatttttcagacatggagaaacacttagacaaacaaaagctggggaatattatcaacattagacctatcttataggaaatgctaaaggaagttttttcaatctgaaagaaaaggctattaatgagcaagaagaaataatctaaaagtataaaactcgctggtaaaaataattacacagagaaatacagaataatgtaacactgtaattgcagtatgtaaaccactcatatacttaatagaatgactaaatgataaacctatcaaaaatagtaactacaattattttttaagagacagaccatgtaaaaagatacaaatagataaaacaaaaagtcaaaatgcaggaaaaagtgtagatgtttgtttggctttctctgcttgtttttaaaaacttttctttctgataatagttaagttgttataagtctaaaataattgtttatgagatgttatttgcaagcctcatgataactacaaaccaaaaacctataattgctacacaaaaaataaaaagcaaggaattaaaacatactactagagaaaatcacttttacacaaaggaagatgggaaggaagaaaggaagagaggaccaacaaaacaagcagaaaacgagtaacaaaatgtcaatactaagtccttactgattaataataacaagtaaatgagtgtaaatggactagaatcctttttagaaggcactctaaacagttttgtctcttgttatggcattgattgcctttagtagattccgtgtaacctacttctttatctcataagttgtagaagttctttgctccaaaatatccttctcagactttaaatccggtgttgtttgaagcattcttctcgcttctcagtaatcagtctagcaattaagaggaaatgccataaatgttaatcacgtctcaataagacctgtaaactccactgcatttaaacgagattttatgagactcagacatacaggatgtattctcagcctttaaggagcttatccaaatggtgacaacacaatagctacccattattagcttccaacatttatcagttattgtgataattaacttgctaaattatctcttatcttgacaaccatgcagaagggtgttattaccctctggttaccaatgagtaaactaaggctcagaaaaatgtagtgcttcagggaacacatctaataatttgcagaaatttcgatttgattgtttgggatccatagaaaaaagccaggaaagatacgaaaccatgctgaagtcttaccttctctttgacaccttctccagatatatgtgtgtatatatatgtatatataaaattttttttttagatggattctcactctgtcacacaggctggagtgcagtagtgcaatctcagttcactgcaacctctgcctccttggttcaagtgattctcatgcctcagcctcccaagtagctgggactacaggggtgagccaccatgcctggctaatttttgtatttttagtagagatggggtttcaccatattggccaggctggcctccaactctggacctcaagtgatctacccacctcggcttcccaaagtgctgggattacaggcgtgagccaccatgcccggccttttttgtctgtaactaattctgtattttataaactcttaaataatttatatcccagtccacacattttgattcttattatatactattgtgtattctaggcaaaggttcaaatgcacaaggtgggaataaatgtgacataattgaatacctagtctggcttatgtctggttctcccttcctcaatagagctggagcaagactggctgaaatgaccaccaggcagatggcagattgggaagacaaactgaaaaggtgagaggtggaaagagtcagagaataactggataagccacattctgggaaatacagtggttcaaatccaccgtggataaatttgtatttgaagattgaatggtaactgggaaaaatagagaaggaagccattgcttaaactatgcttgaaagtcaccaaagcagtgggttggaatagcatgtcccaaaaggccacttcacatcctaaataataatggaataggataggatttcagataaggaagtagggaggaagtggaaaataataaggctaagagaaaatccagtgttaataatggaatttagttaagcatattttccttagaggaatcaaaaggaaacaacatacaaggaggagatgctcactctccctttatctctcacagttttataacctcacctgaatctgttctttctgtaccctagaccttctaatgaatcaagctcagctcattaaccaccttctttggttccactgagccacgctttttcagacaatgttgctttttgttcagcataagttccttcatctaattctaatacctgttactcatccagtggctaaatgtggtagccagactccaagatggctcccagtggtccttacctccctcgtattcatgcctctgtgtggtcccttcccacactgtatcacaccgattcatctgaccaatagaatacagcaaaagtgaagatgtgtgacttctgaggttaggtcatacaagacattgctgtttctgcctttttctctcttgaacggcctgttctaggggaagcccccatgtagtgagcacactcaggaagcctatggagaagcccacgtagaaaggaaccacggcctcccgcccagagccatgtgaagtgaatcctccagccctagtcatgcctttaggtggctgcagcccagctgtcatcttgactgcaacctcataagagaacctaacccagaattacctagctaagccattcctgaattcctgcccataggaactgggcagataattaaggtgtgttgttatcttacgtcattaagtttgggggaatttattacatagcaatagtaattttacactagattagctgtttttctaaaaatataactttcatcaaagctccttacattcactaccaccacccaaataggtccttgctcctcggtcatcaatgcttataattagcaagtgtactttaagttcctgaagagcagcagcttcaggagcctactttgaaagcgccacctgctggtattaacttaatagcttcccaaagaaagctggaataatt

SEQ ID NO: 79 - DNA, 155038 bp, Homo sapiens
agaaacatataatacaagacaagcttatacagatgataaaatttacacctcacaaaaatgaatttatggttggaaacaaagcatggtttttaaaagatgaaaatgacctggctttaattaataacctttattcaaaaacatatactaggccaggtatagtggctcatgcctataatcccagcactttgggaggccaaggcaggaggatcgcttgagcccaggagttcgagaccagcccaggcaacatgatgaaaccccatctctacaaaaaaatacaaaaattagtctggtgtggtggtgcatgcttgtagtcccagctacttaggaggctgaggtgggagaattgcttgagcccgcgagatcaaggctgtggtgagctgagatcacaccactgcactccagcctgggtgacagagtgagactctgtttcaaaaaaactatgggtgtgtgtgtgtgtgtgtgtgtgtgtatgtatgtatatatgtgtgtatacacacatatatatacacacacacacacatatatatactgagcctaccttgcagattggctatgaagtccacaaatgttaatagtattataataatgattattaccatcatcatcaattcaatgaatatttatcaagggcctattatgttgaactgctggtgtgcaatacagacaaggcccaccttaaagagtttataagctagtggggaataaaaatgccagcaagcaagtaaagaaatgattatgacattgagataagtgtcatgaagaaaataaacaagatgctgagatagggagtaaaacaaagcaagagattacattacatcatgcatccaggaatagcctttttgtagtagcttctactctgggtcataacaatgaaaagaagccaggcttatgaagagccaggtgaagcccattccaagtagaggggatgacatgtgcaaaggcacggaggtaggaaagcactggacatgccagaccatggctagcacataatttgccatggggcaagtggcacaagatgaagttggagaaatgatagcagtaataaaataataggtttaattctgcactatggaacatgtagtattttcaagaatgtacacaatttttaaattatccaagttatttaaaacctccaaattcaatttaaatttttagaaaaatttcagtcagcgaattaactgagggcagaggaaaaatgaccataaaaagatgttgttctaaaattctagtgcagccatgtatagatgcacttgtcttattcattctgctctattataaatttctttctttcttttcttccctccttccttcctccctcccctccctctttctttccttccttccttccttccttcttctttctatcttagttggagttttgctcctgttgcccaacatggagtgcagtggcatgatcttggctcactttaaccctcacctcccagattcaagcgattctcctgcctcagcctcccgagtagctgggattacaggtgcctgccaccacgcctggctttttttgtatttttgatagagacggggtttcaccatgttggccaggctggtctcaaattcctgacctcaggtgatccaccgacattggcctcccaaagcgttgggattacaggcatgagccaccgcacctggcctattacaaatttcttgaaagcagggactgtggattatttattttgtatctctccctcttattgtgatttgcacataccaagaatgtgttcattgaatatttattacattgaaccctgtttaaactttttcttaaatcctttcatgtgaggccaaataatagatatagctctgagaactccttccctcttggactttgccttctggtagtttatccaggcaaaaactacagacgaccctattttatagcaaccagagcaaggaacaagaccacaccagccttttaaactgacaatctattagatactttgaggggtaggagttgatgttttttatgacaaaaaaacctgggtactattttttcctcttcccaatttttatttctatatgtaaaaagaatggctgagaagtattggaaattttttgccaagaacagagcttaagttcttgctagaacttcaaaagattttgcatatccacctatgtgacaccctttgttaacattaggtggccccctttaactggttacctgcttcttcaccaaaagttccgtatgtggttttattaacaactatttttacatacctaggattagacggaatcttgaagtcaggaaaagagataattccaatatgatcaatttcttctaccatgtcaacttctgatccttcaggatcctgtaaataaaaacaaacaccctcaaaggccagaaactacattttaaaaaatttaactgattatacaatctttgatgtacaaaatatttatagatcaaatatttgaagacaaatacccatgtcttcaaattaaatatgaaggatgaagatctgttaaatgttatagaagggaaatatggttcatttcagccatttcccttcttctttttccaatcttccccatctctcctcattatcttgaagagactcaactctcgttgtacatctaaaagatgaagtgtaacaacacgtaaaaacaacaacaaacaaacaaacaaacaaacaatgatgtttttgataaactaaatgtgaattttgttggctttataaacaccagaatctaatttttatatatgttcatttaaagctttcaaaagcaaatattctatgaattatattttttagccagatgttttataaatgtatagtatgggcatttttcagcttggtaaaactctcaaatggttaaacaaacttgacagttctcgtaaagcttccccataaacttaattttgtgtttgggttagcaaataattgaaatgaggttttgactttctttggactacacatgggggtccaattcagccttaactcaacacataaacatagcaggcaacataagtgaggcccctatctgtacaaaaaacttttttgagacagggatcttgctctgtgatccaggctggagtgcagtggtgtgatcatagctcactgcagctttgaactcacaggctcaagcaatcctcccacctcagcctcccaagtagccaggaccacaggcacatgccaccatgcccagctatttttttttttttaatttttagtagagatgaggtctctccaggttgcccaggctggtctcaatctcctgagctcaagcaatcctcccattttagcctcccaaagtgctgggattacaattacaggcatgagtcactgaccagcctacaaaaaaatgtttaaagagttagcagggtgtggtgatgggtgcctgtagtcctagctactcaggaagctgaggtgggaggatggcttgagcccaggagtttgaggctacagtgagctatgatcacaccactgcactccagccttggtgacagagcaagaccctgtcaaaaacatacaaacaaaaacaaacaaaccaacaaaaaacccaaagcaaaaaatcttagcaccatttaccatgactgaaattcacagttggattttagaggttttatttcgtaattaattgtaaaacttacagaagcctattttgaacaagaattatacttgtagctgagtatttttatggctcttcttcatcgcactatccattgtgcacaattcttctaagatcatctttctcaggtactattttgaggatacttcctctatattaactccttaaggctctgggatcagctttctcaatcttttcttcctggggcagctcttacaagagatgactgacattcatttttctgcaggttatgccatgattctgcatcacttaagttcaaccatgaagacgttggataaagagcatacatccacacccctatcattccctgatagaaaaagggcatttgagctgacattgctctccttagttctctttcagacattctatcagtcaatcagtttatttactagcttcatttttttttatttcttcttgcccccatagcttaactcacactgtttcttacatggatggtcttcactatttttaaataatttatgtcaattcctttcattaacacccaactcagggttccctttaactactccgttccagagaaggatgtgtatcacccccactctcacctctcattggtcttccctctgagctcatggtatttgtcctactgtataatttatttgttttatattttagtatggttttgttctgtagtatctatgcttttgcacctgcattctgataagtttttatttttattttttggttttttttttgagtagcagcaaaagtgctgcagcctatattgaaggaccattagtagtatacctactgttaataactgagcagttataactagttgtattattttatttcctcacaaaagtgtttggggtatgtgacacaaattagatgagatcatgggagttcaatgcacagcgtctgttacatatgtcatgtctgataaatggtgaattactgccaatctttaactcatgatttagcaagattttttgtgttagtataatagttattaaactctaagttccttaagagtaagtaccattaaatatagttcttttgcacataataaatacataatagatatatccattatgtatatcttatagttaaatgggtattcagtcaattcttagtgattggtgggtggttttttgttttttggttttttttttttttttagattttcttttttgagatggagtctcacactgtcaccaggctggagtgcagtggcacaatctcggctcactgcaagctctgcctcccgggttcaagcaattcccccacctcagcctcccgagtagctgggactacaggcgcctgccactgcaccagctaattttttgtattttagtagagatgaggtttcactatgttggccaggttagtctcgatctcctgacctcgtgatccacctgcctcggcctcccaaagtgctgggattacaggtgtgagccaccacgcccggccagtgggtgttctttaaaaaataaatcagcaagattgtacttaaatggtttagctcaaaatccttcaagttattgaaatttaatttgtatgagcctttcacatacgtgtattacagaggtatagatctatgattctatactcattgcagatgttcaataaccatttatggaacattgaatgatttagtgtagtgtgaggacagggttatgaaatgagattcttgtcctgaaaaatgaattaaagtattatttaaataaataaaatacttactatgaaagttaagacagtttctcttttggctggcttcaagtcgtcattcaacgaataaactctaacttttactgtaagaataattgatataatcaaaaactctgctaaaaacaaggatattttgattttttaaaacaaccatccttaaaagagatgaatcttactttaaaaaactcaatacacaaaagtccatatttgaaaaaaacaaaaattagtttgcagacatatacattactaaagattctcttatttaagagaatcctcagggattcctttaaagaactatttctcttagtggatttaaagtacagttcactttcttaaaatacatttacctacaatgttttgagaaaacattcacagtatgaaattaattacatctgtaattaggccattatttattaagaatttcatagtagcaaaatagtgacatcaccatatggttatagaggagcataatatattgtctcagagttgaagatcttaatggaaaattgggagcttgattcagacatacactcttccacttatgaaaacccacaaggctccaaattagctcttattgcaaaaggcagctttggattatatggttttgttctatttattgagccagatcctacacttgttcgctcattgttaaaagagcaatggcaggggctcaataactgttagttctcttccatttctttctgtcagttaatagatccctactttttaaacaaaagcatctgtttcgcttttaactcacagctgtttgagacacagtgatctaattctttccaatgacaaacttaatttctctagggtgttgctgatgctcaaatcatttcatggccaaaactttacccacaaaataaaatagaactggcaccataaacccagtatcttttaaaagatcagtattatgcaaagctctatataagaagccacattaacactggttttactaagttcacaagataaaaacaatgtgctcagtaaatgccccacctctctgctctctccttcccctcacacctgtctcccaccacaaatcctatctcctgctttttgggacacacccagtctaggcctgagtatcactgggaagctgcccaagtcagaaagtcacaaaagttaagagcacaggccctggaattaaacactttggtttcactcctgcctctgccactttttagtatgaccctgagcaggatacttaatccctctaaaccttagttaactcacttgtaaaacaggaatactagtgtgtgctcatagtgtccttgtgagaattaaataatgcaaagcttttgcatagcctgacacatactaagtaatcaataaatgtttattttattattatttctgttactactatttggctagtttttaacccagtttgtgtttaggttagaaaattaatcttgtcttcacagcgatggtacattggaggcaagatctatacaattttttgtataaaagatatggcttattggccgggtgcagtggcttacacctggaatcccagcactttgggaggccgaggtaagtggatcacttgaggccaagagttcaagcccagcctggccaacatggtgaaatcccatctctactaaatatacaaaattagccaggcatggtggcacgcgcctgaatcccacttacttgggatgctgaggctggagaatcgcttgaacctgggaggcggagattgcaatgagacaagattgcaccactgccctccagcctgggtgacagagcgagacactcactaaataaaaataaaaataaaagatgtggtttattaatttaaaaaaagtttgaatgccaggctggagtgcagtggcgcaatctcggttcactgcaaactccacctcctgggttcatgccattctcctgcctcagcctcccgagtagctgggactacaggcacccaccaccatgcctggctaattttttgtattagctcacatcccgtgtgagccaggatggtctcgatctcctgaccttgtgatccgcctgcctcggcctcccaaagtgctgggattacaggcatgagccaccgcgcccggccttgaatgccttctaatgtgccagtcattatgctacgtactgagatacagtagtgaaacaaatcagacatggacatcttttaatggtgtggaggaaagaggcaaacacaattatatgtaaaattctagggtgtgaagtgccacaaaggatatttgcctggccttatgagcatgtagaagagggagatttgaagaggtcagggaaatcagcgaaagctgcctttagaaggatctgtgatgacacgtgagggtgaagtaggagttaacaaggcaaaggaggggcaagaatgtaccatgtagaggcaacagcatgttacacaggccttaatatggatggggaaacggtgtgagaaagcatctgaaaggaggtcagtttggcttgtgtctatagagggtggggccgtagtaggtgatgaagctggggaagaaggcaggacacaggctttatgaaattgaaggattttgggcaatattctaaagtcatttatccagtaaagccttgaagcctttatcctaaagatgcttacactaaaaatccctcaagaatcttcagattaaatgtgttgatcgggacattatagctataaataacaagacgattaaaaaatacttttaagtaattatttttcttttctgtaaatatggctttgtgctattccatagataataatggaaaacactttcctagtgcttactgtgtgcttggctctatcttaagtgctttacacatactaattcagttaattctcacaactctatgaggtaagttgtattattatctctattttacaagtgaggaaagtgggagtctgagaggctgagtgattcacacagggtcatacagctcacagcagctcaagctgtgacttgaacccagacaatctgactccagagtctgcttttaaccaatttacttcactatcttgcagaaatgggccaatatttatagcaaacttctctcattttactctacgattagaatggatgaggatattacatcgtcttctttttttttctcttttttttttttttttgagacagtcttgctctgttgcccaggctggagtgcagtggcgcgatctcactgcaacctctgcctgccatgttcaagcaattctcatgcctcagcctcccgagtagctggaattacaggcgtgcaccaccacatccagctaatttttgtatttttagtggaaacagggtttcaccatgttggtcaggctggtctcaaactcctgacctcaagtgatccacccgcctgggcttcccaaagtactgggattacaggcatgagccactgtgcctggccaggtattacatcatcttacagtaaagtcctgatagagaaataatacatgaagccttttttttttttttttttttttgctgagacgaagtctcactctttcgcccaggctggagtgcagtggcttgatctcagctcactgcaacctctgccacctgggttcaagcgattctcctgcctcagcctccagagtagctgggattacaggcgcctgccacagtgcctggctaatttttgtagttttagtagagacagggtttcaccatcttggccaggctggtcttaaactcctgaccttgtgatccccccacctcggactcccaaaatgctgggattacaggcatgagacatgaagccattcttaaggaaagccttgataaccgaggaaggtcccagcctctggatattacactgcttactggacaaagactgatgacccttagttgtgggacgtgtcaacaggatccaagcaaaaaagaatccttcaatgtaggaggaggacaagagagatgatatgcttgtttctaggtatgattatgtctaaaaggacccaacctttgtgggcagagactatttccttgtataaaaagttgtctcttggagaaaaaagatgctattattctggagattttattctggccaagtagatagcaatatctccaccccctttaggcttttcctttctgagctgatcataacaaatgctcctgctgaaacggtaatggttcagtccagttccaccccactattctcatcatcaacatcaaccaacatttagcaaatatctactgtgtacaaagtttttcaacaaagtcagatggtccccacttcctttctctgtcctcctccaagaatatcattaatgaaattccatagcctctccttcccatatatacatctctaatattctatttctgatgtacttaaaagtcattgatgacgagagggagaaacgggggaatggaaggctttgcaaacacatgaatatattgggaagcattcatacttttctgtgttttacttttggttcattgggaataggtccagtcattcctattcacatgattttgattggctattctgcccttttgcctctaacagaagaaccatgaatgttaaacaatgttctaacagtaactttcttaggtagatcccctttgaaaattaatatccatatatttctgtgatctagtttatcctctgctgaaatatctgatcccctaggttagatttatttttccagtttggggattagctccagacccagtggaatttttaatgaacatggttctacaataaattatattttcccattgccaaattatatttgcaattaagtcttatatttgtttaataaattgtaacatattggaaaacaaatttttcttgttttccaaacttttacaataatttcgcatagctaattctacagcagttggtttttgtaacaacataacattttacatttttacataacattcaacattttacaattttgaaaaagcattttctacttggaaataagtgatggggcaggtaatgtaattgttggttttgtaatttatttagcactttctccataaatttaaaattaaaatgctattaaatatttgtaagtatagatgtctttgggaattgagagtcttttgagcaaattaaaaagaaaccgatctccactcaatttcaggtattaaaaagctctacaatatagtgtcaatactgtcaaatcccccacccagaggaagaaatatcttataatctacctgactggtctggagtataaacaggtttgtctgtatgaatgaagagaaatccattgtcataggttattggcattctttttgattttgaaaaatgctttgatacaacttccaaatacacataagaaactgggttttgtcctccaggcaattgttttggttgtatctggaaaagaaattgttgatggaaaaagtataataattctaaagttattaaaccattaactttctaaatacaactgtaatctcattagaacaatcagtatgtatatgtaatcatttaaaaagtgatacaggagcaagaagagtaaataaattttgcccgaagcccttcagtgtctaattacataataaaaatttagctttaagcaattgaaagtctctttggttccatgtttcctaaattttatatacatttagtgaaactactactataaaagcctttaagaaaccttcactcaattagtttgctgggttaccccatgctccccattccctttgtgaaacctcctgaccgattctctggacccttagctttttttttttgagacggagtctcacttactctgttgcccaggctggaaagcagtggtgccatctcagctcacgacaacctctgcctcccagattcaagtgattctcctgcctcagcctcccaagtagctgagattacaggtgtgcgccaccatgtccagctaacttttttttttttttttttttgtatttttaatagagacgggtttcaccatgttggccaggctggtcctgaactcctggcctcaagtgatccacctgcctcggcttcccaaagtgctgggattacaggcatcagtcaccgtgcccatgtgtccagcatctctggacccttagtattacctcacatatttctgctcccctgagttgagatgctcattttccaatttatgtttgtaattatcccctttacattcaatgatatgtaaatttaatgcatgaaaagtgataaaaaagaaaagtgtatctatgaaaaattaggctttggaaacacgggatgaaagttaattacaaaaaccaactgctgtagaattagctatgcgaaattattgtaaaagtttggaaaacaagaaaaatctataaatattctgcacccagattgctttgtaagtgcctttaagttctttctccccttttaagaaacagaaactatagaacaggctgggcacagtaacctatgcctgtaatcccagcactttgggaggccgaggcgggcggatcacctgaggtcaggagttcgagaccatcctggccaacatggtgaaacaccttctttattaaaaatgcaaaaattagccaggtgtggtggtgcacgcctgttaatcccagctacttgagaggctgaggtgggagaattgcttgaacctgggaggcgaaggctgcagtgagccgatattacaccactgtcttccagcctgggtgacagagcgagaccctgtctcaacaacaacaacaacaacaacaaaaaagaaactatagaacaaagatgatccattaaatttgtagcacgtaataaatgagatttgacactgcaatccatagacccacacttaaaagaccttggtacaacattaaacaattggcaaataaagatacatgatattgctatgataaaattaaatggttaaaatatgtattgactatgattgccccaccttaatctagtttttcagttaatcatataggtcagcactgttcagagaactttctgtgatgacagaaatattctatatctatgctgtttactatggtagccaatagctacctggggctatttgaacacttgaaatgttgctagtgcaactgagatactgcatttttaatttcagttaaatttgtttgatttaaatttaaaactaagagccacaaatacattgtatcagataaaagagtgtcttttgaaagtaacactttctttttttttttttttttttgagatggagtctcactctgttgcctaggctggagtgcagtggcgcgatcttggctcactgcaacctccgccttctgggttcaagcgattctcctgcctcagtctcccgagtagctgggattacaggcatatgccataaaagtaacacttttaataaatgaattttaattgttaacaaacctaataagtggaagaatttgttaagagatatgagcatttactgctaagaacattaaagaattcctatgtttgactagaaattttttagattagtgtttcttaaacttgagtaatatgcatagtccttttaaaggacaaaagtcatggaggaccctcagcattggctttttattatttataacataatcaaaataatttttgatacaaagatacttaaatatatacaaacttaaaacggtacaatcttatgcttatgatttttgtataattaaaaactcaaaacaaatttataaaataaattcaaaatgttacaaaatcaatataattcgaattttaagctctttattaaatttccatttttaatttctttataaagaactcactttagagaaactctggtctaaatgaactgcagagcccattttacgtctgatattctttgattttctttattaagtatcagaatttttagtaaaaataagttgcaagtatgtctctaagcaatctatactacaatatcttaataggagagttatttgatcaaggttgttctttctattaactgcaggttgtcaatgagagctattcactttagtaatcacaaattttttagtttttgaaactataattgtagaatattagagttcaatcgaatgttcaataatatccatggatttttgtgggcaatgtactacagataaaatcatactcatatttctcaatttctttctaatagtaattttcatagcaaacaagtattttcaattatctccaaatattttcacattagtacaattttattttccaataagaatgtgaaaatggacatgcattgctcaaaaagcagacataacttctgtttagaattttctgtttctgttagaattttcacttacattatcattagtgactgacatcatctaataatcccacagtggatgtaaatgattaaatctatatgttatcaatattcaaactttgtacacatttttattgagaatattctgtatatatatataaagaaaataaaggataaatacatactgttaagattgcagagttttggaatttattctctgaggataaatgaacatggcctgaggagtaactaaattttttatcaggataacttttaatagagattgttgcatcaaatgcttcagtgtatccataaacttgaatcacaatattttcagatgctccaacacggaatatttttggtgctgaaatgacatatctgttgaaaaaggaaaagataaggctcaatgtctttatatgacatattttcttttacttttgatttttttctctcacttgagagattccatttaaaatacatatatttcctcacttaaaaatgatactaataagtcaaaatgtacttgtgacccaccataacttcagcataatttccaagtagtttggaattaagacctgagaagctggaggtttagtttacatttagaaagttaaggtgatagcagcactttctcttagctactgcagccaaggaagacttttaatcatgttgaccagaacatgtaaatggggtcaatattttttgctcaatgaagaaaaaagcagtgattgaattccagctgtggcatctgctggctgagtgaccgtggtaaagtcactaagtctttctgaggctaaaataacttactgtgaaaataatcgccttctttaccaggctctggtaaagattaaataagaacatatatatgaaaaggtctagcactcttagtactcaatacatgttaagatttattaatctcactaaattagtttaaagggagtgatcttagaaatactatgttatactagtaaacggataacggaaaggatagaatatgagtgagctgggaagtgcatttggaaatggaaatagtgatgatggtcctttaagagcaaatcatcatcttcaaacaataatggtaattaagtacttgccacatatcagaggctgtatcagcactttacatacagctcttgttaatttttacaataagccaatgatgctggtactatcattattcgtactttgcaagtggtaaaaggctaacttggctaaggttatacggtttgtaagtaaatgggggaggcctttatatgagttctcagttgttatgtgtacagttgaggtcaagtttatatgttattcacaaccatagactgttctcttatttttacttttcatgtgatttatacaataatggaagtgagtctatacatgcttttgagtgatttttaaaaattattttatttaaaaacttacaaatataaactggattactaagtgtatatcacaagagtatctaatttgaatagcgagaactacatacgctattacataggaaaaaaaagtgttttaacccaaaagggcatagtgatcgactaattcaagtggcccaacaagcttggagggcacccaccaccccacctggcagaattattccaggcttctgccaacattgtgacattttaagagtctggtaaaagcaggaagtttttagtaacaatggaattaatttatcagcaattaaatcctttaaagcatctgacagttatcctgcattacaattaatttggatccacttacaggcaaattacaaaagagaggaaagaatttccagatttccaaccatcatctgaattccccttccccacatgcctagtaggagatggcagaaaatgagaggagttcagtttttatgataataagatatatttactgaaattttgccctgtgataaggcactattctgaatactttatttgtataaactcattgtgtcattacaaccactctgtgaggaactattactccaattttaaggtgaagaaactgctaattaattttcccaaggccacacatataggatttatgaattctataattcacaaattatagaattagaaatcgaacctgagcagcccgtttccagaattaacattttcaactgttgtactaaatggaatttataaagagttttgtaattagaaaaatttagggatataaagctactttaatttcagtatttatagaagctttatgtttttaagtttagtattgctttaattttgaattgtgtatggtaggggtccccaacccctgggccatggacaaataccagtccatggcttgttaggaaccaggctacacagcaggaggtgagcagtggggcaaaggagcattaccacctgagctctgcctcctgtcagatcagtggtggcattagattctcctaggagcatgaactctattgtgaaccgcacatgcgagggatctagattgcaagctccttatgagaatataatgcctgatgatctgaagtggaacagtttcattctgaaaccatccccaccccaatcctggtccatggaaacattgtcttccacaaaacctgtccctagtgccaaaatggttggggactgctggtctatgtgatggtagccgtcaagcaaaaatacatagtgtttagaagcccctaaaagaatattctggaaccaccctttataaagattttggttcttattgacttatcagtagcataatctatccatataaataatttcatagttttctttgtctttcaattgctgcagaggagcaggagcttgcagagaggcaagaatgttattttggcctctatctggaatgctctttcctcaaatatttgcatggtttgcttcctcacttccttcaggctctgtttgagtgcagcctccttaagagaacctttcctggccacattttaaaatagtgccccataattattttttaattctcatactctgctttatttttttcttcataatactacctacctgaccttacacattctttcattggttcattcattcattacttgcttctcccactagaatgcaagctctaggaattgtcttaccgtttgctatatctgcagtgcctatcatatgtttagatgctcaataaatatttgttgaatcaatcaatcaaccaattaattaaagtgattgattgccatgttgtaaatggtacactctgacttcttcagagaaagtgaggaaataatttttattaagggctagtagaaagaattcagaataagtctggacaagaatcatggaacccaggtcctagccctagttctgccaccaatttgaagtcacttaatttcagtctctctaagccttagctgctcgtctttcaaaaagaataaaggcaggatgctaaggtagttgagtgcttgtggccatgtaaaaagatcacagatcagaaatacgagggtgctaaaaaagaatgacatcctaagtatgtgtttatatataatatatttacatgtatacatttatgacaaaatgaaaaaaattgaagtgataaacaggagaccttaataaaaatcctgtttctctctctctagaactgtgacctttggtcagtcacttcccttatctggacttattctcatatataaaatgaataggtttgattagatgatctgcagttacttttcagtattaaaatatttctagatataagatcattatttttaaaacattacttaaaatgcatattatctcaataatgacactaaaaattgtgaaaagtcagctcataaatgtatggtagaagtcactacaacaacagattttcagatcacagtattagattgactcctaaataaccctggtttaactgtgtatagtctatgaaaaacacaaagaaaactaaacaccaagttaaaataagcaaaaaatgtcaagaaagtttattatctggagtttcttttgtgcttttttgaagaggaatttgaataatcacttaacgtaaattttaataaataacaattccataaaagctgtcatgttgttagctactcatcaaatcaaaatgcttccatgactttctcattcagagatgatactattcacttgctgttctcagaagtagcaagttattttcaagttaacagaatctgttaaatttaactcttcattcgtcataactaagatgcattgaaaaatgaagatagcttgttttacttacgtttgctcctgtccccaggttttccccaggaagattaaaaaacaaagtattcccaaaaggcccatggttggaggtagcaggaaaccacggatataacacttttgaggatagtctccttttaaataaactgaacttgaagaattcagataatctggttaattattaatgtcagaaaggtgaacctctaagtgggaaaactagaattggaactaaaacaccctttcatgcccaggaatacagatagggagtactttacaggaacttacacccagggaatttatttttattaatacaaataaagggaccctaaaatgggaatttggcactatgaagagtggctcaaagctagaaaccagtaagcccattgctttggcctttcttctcttgcccagggcatttgctttgatgttgcatcatctgcaagcatacatctggcaggtccactctaatactgatgaagacccacctggactcagtttcacactgaaatgattttagaaggggcctggtttagacagggctcacaagatgatctttttttggtgacctgaatggcagtgtccttggtgctgcaaatggtctgagcataacctagctctgcaaaggaggtctagggaattgttccttggtctgtctcagtctagagaacactaggtggaggaaagttgtgactggcaatgaaaacgccatgtggaggatgctgtcgtcattctctaagtattggagaatagatattctccaatatttattaaggcatataccactcgttcaaagtttgtctttattcagatatagaatatctttcttttaaagaaaacacatgttatacttttcagtgaggattttaataattttaatataagagctccagaaaaacaaagcttcctataacaattgagtctagtaattaattcacaatatactaaaattttatctttatacttttttttttttttttggagacagagtctctttctgtcgcccaggctggagtctagtggcactatcttggctcagggcaacctctgcctcccaggttcaaggcattctcctgcctcagcctcccaagtagctgggactacaggcatgtcccatcacatccagctaattttttgtatttttagtagaggtagggtttcaccgtgttggccaggctggtctcgaactcctgacctcaggtgatccacccaccttggcctcccaaagtactgggattacaggcatgagccactgtgcctggctgatttttaattaagttaatttttatgatgttttatgttcattagaatttttttatttactaccttctcttttttagtactatttttaccttaatatataatatgtactcttctttaaaataataaaacagatgtctctaaacatatttctataatgagatatttatgatatataaatgagatatttatggtcacattggcattctttgctttgaattaataaataataaaccaaaaatatttataaacactttaatgctgaattcactagggaaaaaaggagcacaaagggaaatttgatatacaaatttcactaaaggtatctcttgcatatgtcattgaaatgacaaacatttgccactattgtctgatcatctagcccatttatttcaaaagggaatctgtgaaatgattaagctgggttgcaaaagatgggtcaagttaaaacaaacagtacttttgccatcatttttgggaaatgaaatttaagagagaacaacaacactcaaatcaaggtaggtaatatttgtattttaagtgcaaataagtttgtttgcttgagctatagagtaaatactgataaccaatatttgcaagccattgtcctgtttctctggtagaaaacatttagagaatgatggatctcaaagattctcaacagaactgaagtttaacaatttatagattctaagctgtgtttagtcaaaattttttatctaccttctaaatgtggctcacagatgaacttttgaggctgggcacgctggctcacacctgtaatcccagatctttgggaggccgaggtgggtggatcacctgaggtcaagagttcaagaccagcctggccaacatggcgaaaacccgcctctactaaaaatacaaaaattagccaggcgtggtggcgggtgcctgtaatcccagctacttgggaggctgaggcaggagattcacttgaacctgggaggtggaggttgagcacagatcacgccaccgcactccagcctgagcaacagagccagactccatctcagaaaaaaaaaaaaaaaaaaaagatgattttttttctttataatttaaaatgtgacctttggtaagcctttcatttttatacaaatactgcatttctaaaagagaagaaactcagatctggcagaaagtttggtggtcacctgaccttcctgctaatgctgcctcaattgtcccctcatgattgagcccaaatgacctagcctagtgcaccaggcccctcttgagccctgcttagttctccagcctcaacattccattcttcactccggccaaggagctgaattacctgattattccctgaagtcaccttgacaccaaggtgctcctagcaggataataattttgtatctttcaaatggatattctttagttattttgtacttacttggtaaaatatgtctggacaccaattttctattaatacaaactacagaactcttttttatgtataataaaaagattttatcatgtataattttcaaaatcagacagcttacagggaggtatattaatgggttgtaaatttagagaataaaaaataagtgacattgtgtttgttattgttttcagaaattcagcccatcagattgcgaacttcaagtgcctgctggctggctagagtaagagaggtgatgtgacccatagctgccccaggtaattttcatgtgcctgttccatgtccagaggccagtggagaaacagaggcgtctcctcagaattaaattattctaaatggagacacgggaatcatacaagttttgttcaagagtggtaggctggcactaggcaggtgggttattctaagtaaaacccagtatttgtccctctgactgctttttggctcaagcccgcagtctcacgttttaatcctttaggagaaaggctctactaaaaggccaactgaaatccaaaaagaactacttcagtaactctccatgggatatagaggagaaaggcactggaggcttcggtgccagcagtttaaagactgactggagagagggcggaggtggagcaagatggctgaatagaaccccccccgagatagttctccacacaggaacaccaaatagaacaactatccacgcaagacagcaccttcataaaagccataaaatcaggtgagtgatcacagtgcctacttttaccgtaatgataaggaaagaggcattgaagatagggtgggggtaggggggaagatctccctgtattgcctataccacccctcctccaaccacaggctgcacagcaggaaagagaatccgtgtgcttggaggagagagagcaaagtgagtgtgggactttgcactggaagtcagtgctgccccgtcatggtggaacataacacaggacagaattctgcaggcgcctagaattctgacagtgcatttaggcaggccttgggacagaggagaattctgtgctccagagggagaaacccaggtcatggctagcttcaccactggctaactaaagtggtctgaggtcctgagtctatttgagtggcagtcaggacacaaggactaaagtgtgtagactaaacataaaatgctaagcacccccaacttgccccctattgactgaatgaactcccacttggccaaagagaccccagaaacatcttaaaaattgaattcctggccgtgatgggaagggaggttagacatgccttgttataccccctccctttggagtttaggcacaactgaccagcattcaagttaaaatatcataagacggacaaaacagactctgtggcaataagataccaaattataaacaagacctcaggccattcatgcaaggaatcacaccctacaaaccataaaatatcattaaatgagttttaaaagttaacctggtatagtccgggcgtggtggctcactcctgtaatcccagcactttgggaggctgaggcaggcagatcacctgaggtcaggagttcaagaccagtctggccaatatggtgaaacctcatctctactaaaaatacaaaaattagctgggtgtggtgacaggtgcctgtaatcccagctactcaggaggctgaggcagcagaattgcttgaacctgggaggcagaggttgcagtgagccaagatcgtgccattgcactccagcctgggcaacgagagcaaaacgctgcctcaaaataaataaataaataaaaataaacctgctgtaatatggtttgcttttcaacctgactctgatatagcatcacatgacagatagcagaccctgtagggaataaaaatattttacctcaaaatatatttatttgacatattttgaaatggccctgcaaagctatcttttgtgagtgagatttgcatctgtagataatctccattaatgcaaccaggccttccctttctaggcttttcccagttctggcagagttgaactgagagtctgacatctcaaaggtctgcaaagagacagacgtttgccattgattctctcggagggctgctacctatgaggattcatcaacgtaacaagaaccttggaccccacaacctcctttaactcaagcattacttactattgactttaagcctttagacaatagcttaaccctctcaaccaattgtcaactgaagaatccttaagacccacctataactactaagtccctgcttggagatgtcctgcttttttgggctgaatcaatatatactttccatgtatcgatttatgtcttcgcctgtaactcttttctcctggaaatgtataaaaccaaactataacctacctgcttcaggcatacttcctcagaacctcttaagactgttcccaagaccatgatcactcatattggctcaaaatattccactctgaaatatttcacagattttttttcctctgttagcaagtccttgggcaaggtctagtgctgtcctggtcttggaggcagtggacttagggtgcaacacagtttaacactagctgtggcagccacaggagtatgtatgtcactccttcccaaacttcaggtactgatgcttggggagagattccttctgcttggggaaagaagagagaagagcacagaggactttgtcttgcaacttgggtatcagcttagccacaatacgataaaacatcaaacagattcccgaagcccccgattccaggctttgttcctggatagtgtttctaggcccatcctgggtcagaagggaatccactgcccggttggtacggacttggtcctggcaggattcaccatctgctgactaatgtggccttgggccttgaataaacattagctgcaggcataaccaggcagtagtggctgcaggccttggtgagccccaatacagagctggtctggaaggccatgggcttcaggtatgacccagtgtaatgccagctgtggccagtagagtgtctgcatcactcctcccccagctccagttagccaagcctggagagagatgccttctgatttgggaaagagagggaagagagaaagagactttgcctggtaacccagggaattctcccctatcttcccaagtcttagatacaccaaggctgtgtacctaagagtctgtaagagtttcagtgttcctgggcttagggcacccccaagtgctgagatggctgcagtaaccacaggcttaggccacaaaactcaatcccctttgaattcttggaaaaccttctcaaggacagggacaaacaagcctggactataaagatgggaataaatacctaaatcttcaaggcccagacatggacgaatatccacaattatcaagaacatccaggaaaacatggcctcactgaatggactgaataaggcaccattgaccgatcctggagtgttgaagatatatgactaatcagacagggaattcaaaatagctgccttgatgaacttcaatgaacttcaagacaacagtgaagaaattcagaattctatcagataaatttaacaaagagattgaaattttttaaatcaaatggaaattctggagctggctaaaatatagattactaagacaaagaagtgtatggctacatttcttcccccaatatttgtgactacgtattattttatcaataaaatatgaaaatttcttttaaaaaatcttggagatagaaaattcaattgataaactgaaaaatgcactggagtctctcaatagcagacttgatcaagcaaaataaagaatttgtgaagacaggctatatgaaaatacacagaggagaaaaaggaaaaaactaaaaagaaaaaagaatgaagcatgcctacaagatctagaaaatagcctcaaaagagcaaatttaagagttactagccttaaaggggatgtagagagagagagagaaaaattgggatagaatgtttattcaaggaaatgataacagacaactttccaaacctagagaaagatatgaatatctaggtacaaaaaaatcaaagaatgccgagcagattcaacccaaataagactacttcaagacatataataataaaactctcaatgatcaaggataaagaaaggatcttaaaagcagcaagagaaaagaaacaagtaacataaaggagctctaatacatctggcaacagatttcttagcagaaactttacaggcttgtgggatgacatagtcaaagtgctgaggaaaagaaacatccaacctagaatattatatccagcacaattatttttcagacatggagaaacacttagacaaacaaaagctggggaatattatcaacattagacctatcttataggaaatgctaaaggaagttttttcaatctgaaagaaaaggctattaatgagcaagaagaaataatctaaaagtataaaactcgctggtaaaaataattacacagagaaatacagaataatgtaacactgtaattgcagtatgtaaaccactcatatacttaatagaatgactaaatgataaacctatcaaaaatagtaactacaattattttttaagagacagaccatgtaaaaagatacaaatagataaaacaaaaagtcaaaatgcaggaaaaagtgtagatgtttgtttggctttctctgcttgtttttaaaaacttttctttctgataatagttaagttgttataagtctaaaataattgtttatgagatgttatttgcaagcctcatgataactacaaaccaaaaacctataattgctacacaaaaaataaaaagcaaggaattaaaacatactactagagaaaatcacttttacacaaaggaagatgggaaggaagaaaggaagagaggaccaacaaaacaagcagaaaacgagtaacaaaatgtcaatactaagtccttactgattaataataacaagtaaatgagtgtaaatggactagaatcctttttagaaggcactctaaacagttttgtctcttgttatggcattgattgcctttagtagattccgtgtaacctacttctttatctcataagttgtagaagttctttgctccaaaatatccttctcagactttaaatccggtgttgtttgaagcattcttctcgcttctcagtaatcagtctagcaattaagaggaaatgccataaatgttaatcacgtctcaataagacctgtaaactccactgcatttaaacgagattttatgagactcagacatacaggatgtattctcagcctttaaggagcttatccaaatggtgacaacacaatagctacccattattagcttccaacatttatcagttattgtgataattaacttgctaaattatctcttatcttgacaaccatgcagaagggtgttattaccctctggttaccaatgagtaaactaaggctcagaaaaatgtagtgcttcagggaacacatctaataatttgcagaaatttcgatttgattgtttgggatccatagaaaaaagccaggaaagatacgaaaccatgctgaagtcttaccttctctttgacaccttctccagatatatgtgtgtatatatatgtatatataaaattttttttttagatggattctcactctgtcacacaggctggagtgcagtagtgcaatctcagttcactgcaacctctgcctccttggttcaagtgattctcatgcctcagcctcccaagtagctgggactacaggggtgagccaccatgcctggctaatttttgtatttttagtagagatggggtttcaccatattggccaggctggcctccaactctggacctcaagtgatctacccacctcggcttcccaaagtgctgggattacaggcgtgagccaccatgcccggccttttttgtctgtaactaattctgtattttataaactcttaaataatttatatcccagtccacacattttgattcttattatatactattgtgtattctaggcaaaggttcaaatgcacaaggtgggaataaatgtgacataattgaatacctagtctggcttatgtctggttctcccttcctcaatagagctggagcaagactggctgaaatgaccaccaggcagatggcagattgggaagacaaactgaaaaggtgagaggtggaaagagtcagagaataactggataagccacattctgggaaatacagtggttcaaatccaccgtggataaatttgtatttgaagattgaatggtaactgggaaaaatagagaaggaagccattgcttaaactatgcttgaaagtcaccaaagcagtgggttggaatagcatgtcccaaaaggccacttcacatcctaaataataatggaataggataggatttcagataaggaagtagggaggaagtggaaaataataaggctaagagaaaatccagtgttaataatggaatttagttaagcatattttccttagaggaatcaaaaggaaacaacatacaaggaggagatgctcactctccctttatctctcacagttttataacctcacctgaatctgttctttctgtaccctagaccttctaatgaatcaagctcagctcattaaccaccttctttggttccactgagccacgctttttcagacaatgttgctttttgttcagcataagttccttcatctaattctaatacctgttactcatccagtggctaaatgtggtagccagactccaagatggctcccagtggtccttacctccctcgtattcatgcctctgtgtggtcccttcccacactgtatcacaccgattcatctgaccaatagaatacagcaaaagtgaagatgtgtgacttctgaggttaggtcatacaagacattgctgtttctgcctttttctctcttgaacggcctgttctaggggaagcccccatgtagtgagcacactcaggaagcctatggagaagcccacgtagaaaggaaccacggcctcccgcccagagccatgtgaagtgaatcctccagccctagtcatgcctttaggtggctgcagcccagctgtcatcttgactgcaacctcataagagaacctaacccagaattacctagctaagccattcctgaattcctgcccataggaactgggcagataattaaggtgtgttgttatcttacgtcattaagtttgggggaatttattacatagcaatagtaattttacactagattagctgtttttctaaaaatataactttcatcaaagctccttacattcactaccaccacccaaataggtccttgctcctcggtcatcaatgcttataattagcaagtgtactttaagttcctgaagagcagcagcttcaggagcctactttgaaagcgccacctgctggtattaacttaatagcttcccaaagaaagctggaataattcgtgctgattaagtcaatgcttaggtgcgacagcttttcatggtaaactctggcttctcatcttacattaataactcttctgagaaccagcttctttgcttccttgagataacagctgctttgccttcttcttaagaatgctgaaatgcgatctttcttagcactgaaaatcacataaacatttatggagttcttatgattactctttctaggattactgtttcttgcttttccaactcttttctttctgcttcaattatttttaaaagaagacatgctaaagtctctgttttttacaagaaaaaaaaccaggtatcacaaaatctttgaatttttttttccttccaaaataactgccaaatctctcaaaacacttagtctatccctccccaccccacccagctgactctaagtaattttatttccccctatttatcctgagacccctagaatgctttctggatctcttcataaaagttatatagaaaatattaaattaataaaataattgcccagcagcagaagtcacttgatgttggttggaatgattcagcattatactcattttacagacaaagaatctgataatcagaaggtctgtattgcttcatttaaaaatcccagaatcaggtcgggcgaagtggctcacacctgtaatcccagcactttgggatgtcgaggcaggcagatcacctgaggtcaggagttcgacaccagcctggccaacacggtaaaaccttgtctctactaaaaatacaaaaattagctgggtgtggtggtgggcgcctgtaatcctagctactcaggaggctgaggcaggagaatcacttgagcccaggacatggaggttgtagtgagcggagatcgtgccactgcactccagcctgggtgacacagcgagactctgtctcaaaaataataataaaagcccagaatcacacacacaaaaaagtagctctggccacttacataatttgagtgatcttgtgcaagataaaaatgtggcatctcttattcaaaaaagcaggaaaaatgctgttaaggtattaaaatataaacataaagccttttcctctaccttggccaacatggcaaaaacccatccctacaaaaaatacaaaaattagccgggcgtggtggcatgtgcctgaaaccccgctacttggggcgctgaggcacgagaattgcttgaagccaggaggtcgaggctgcagtgagccaagatcataccactgcactccagcctgggctacagagcaagactgtctcaaaaaaaagccttttcctttcatctgtagtctttccctcaatttgtcatggtgctttttaagatttgctatttaacatcattgtaaataaagggaaattaataactttaattattggcatgacttttatcattcatcttcatattgtgtaccagtttaagctgcaaatataacagcatttcacttgcatgtgcaattgccaaaattacaccatttgtatgtcatagttcatacatgtatatatattccattcttcccagaacagtggaaattatgcacaaaactagctcagctgtttttattttactttttgatatgtgtatgttctacccacactctccacctttgctttctgaggacaaggaaagcctgaaagaaaaagaaactgtgaattatcctatctttccctttctttctatgttatcatattcaaggtacacataatagttccctaatacaaggaaataccatgagtaagaaaggatatgataaggctccttgtttttttgttgttgttgtttttctttttttcttttttagcatgccttcaccatctttctgcactcaaaacaagttcctgttccaatggagaatgtggtctcttcaggctgtcagtgccccggcttgctcagccacagacatacttttcttaatactttgtactcactttgattcccactaaacttctgcaccttgtgagcccactggaattctgtgttcacagggtattgtgaatgctctgtgtgaatgaggaggcaaggaattgtggacataaatatcgtgctgtcagacttcatttataaaaaacaagctcaaagataaaattattaataaatgcaggacaacaacagagcattaaaccaagtgtggggcccttctgcgtgtggggtttggggtgactgcataggttgcatgctcatgaagccagctttggagtagctaagtcaggagtaaactcatatctgacttcaaagacaaatctcttaacacttcacaaggaatctcctctaataacacaaggcaaggtattggcagagtaaacaaagaatgtcaagaacatgagaaaattttaagacaactagataacatcaagctgcttcccttgggttctgtgatcattagtgctacggtctgaatgtttgtgtcctcttgaaattcttatgttgaatcttaatcaccaaagtgatggtatttacagaatttttggttgacagtctttttctttcagcactttgaatatatcatctttctacttagtagcctctgtgctttctgatgagaaatcagctgttaattttactgaggatcctttgtactatcatgtgttgcttttctcttgttattttcaagattatctcttcatctttgacacttgacagttttattatgatgtagtcaggtgtggttctctttgagtttatcatacttggagttcattgagttttcttgaatgtgtggattaatgtgtctcatcacatttgaaaattttgaccattagttcttcaaatatttttttctgtcctttcctctctctctcgtctccttctggaactctcttcatgcatatgttggtatgctcgatggtataccaaaggtctgtctttatgtatatgtttgtgttttctatggcataccagatggtctacaggtctgttcatttttcttaatccttttttctttctgctcctcagactggataatctcaattgatctatcttcaagttcattgattctttttttctccctgctcaaatctgctgttgagtgtccctattgaattttttatttcagttattgtagttttcaaatacagaatttctatttggttcttatttataattttcgtcttattctttgtatggtaagacgtagctcttacacttctctttagttctttagatgtggtttcttttagttatttgatcatactgaaaatatctcacgtaaagtccatatctaggagatcaagatttcctcaggtggtttttattatatcttttccttgtatgggctacactttcctgcatctttgcttgtcttgtaattttttgttaaaactggaatttaaaaaatttaaaattaaataatagaatagagcaacctggaaaatttgacctgtaggttagatttgaaccttaatttagaaatgcttctatttttatgctgtagtggcaatgtgcaaaatgtttttgaaaaattgtttgcagcaatatccagaaaggtcataggactgcaatgcttttccatgaaggtaaccctttaaccctatgaaataagatatgatggtccccatttaacaggataaaaagttagtgatttattccagtgaaaattataaaaagataaggatgcaaaaatgccttccaaaatctagttaacttttaaaactggtggttattctggggaaaatggggaatattatcccattaatgaatcttgagatatttctttgtaagaagaattatatcactgcttctcatgaatctcaccagcattgacctatgacccccatctcttccatttcagttcttttaaattttacttattcactttgttcttgttgttctttttattttttgtttttttaaattattcttttttccttttcctactctatttctcatttccatttcttttctctgtaatatataattgagtatgattttatgtatttgagattttatgtttttcaatcttaagttaacttcacttttttcatttgtagaataggagatattgtctactctgtccacctaacagggtcgttgtaagttttaaacaatacttgttatagctccagaaaactataaactagcttctgttgcttcctagtttatttctttgagtgttttgttaactttcatattgaaactgttaacaaaaatacatttcctgatagttcttattagaccccaagatttcagtatttcatctgtgatagaattattgctgcagattttcatatgtgatagaatctgatattttgaatgtcattttatactttttcaaatgttagcaatttttatattctctcataaattcctcaaataatttatcaactttaattttgtatttctatcaattaaatttttaaaatttaaattcaaaagcattggtaaaatatcagatcttctaagtttgacttctaaagctgaatgtcaattaaattaaattttaaacatatagagttaaacttaattcaaactacaaatttggaatcaaaaatataaaatagtctgggcacagcagctcatgcctgtaatcccagctgaggatttgggaggctgaggaaggcggatcagctgaggtcaggagttcgagaccagcctggctgacatggtgaaaccccgtctctactaaaaatacaaaaattagccagacatggtggcggtgcctgtaataaatatcccagctactcaggaggctgaggcaggagaatcgcttgaatccaggaggcagaggttgcagtaggccaagattgtgccactgtactgcagcctgggtgacagagtgagactccatctaaaaaaatatatatatatatatatgaaagtataaagttaaatttagctttaaatttaaaaacattctaaagaaatcagaattagctgaaatcatcccagtataaattagtataaactgaaaaatccccacaggaacattccatcaaagaggacaaaaagattcttgataaagctggtcctcctttcagtttataaattttggatagtcagggaggaggacattaatccatggatctacagccaatatatttttataggtagagaaaattgcggagaaaattgctggaaggatataaaaatagtaaacaatgacaatatcttggaaagcagttaggtggcagggccaagggcttttaccttatacttcacattcctctatacagcattactttttttgttttgttttgttttgagacagctttctgctgtcacccaggctggagtgcagcagtgcaatcacagctcattgcagcctcaaactccttgatcacagctcactgcagcctcgaatcgctcaagcgattctcccaactcagcctccagagtaactgggaccacaggcacatgccaccacacctggctaatttttatttttattttgtaaagacaggattttgccatgttttcctagctggtctggacctcctgagctcaagggatccacccacctcggtcttccaaagtgctgagattacaggtgtgagccactgcgcccagcccagcattacttttataataaaaactagtataatttttaataaaagggtaaagaagaaggatatacccaagataatcagcaaaaagctgaaaaggatgtaaagaaactgtaagaaaacatattcaatagaaaatgtaaaagaacaggaataagtacaaatgcaacaaacttgaatgggcttaaaatattctattaaaagttagacatttttgaaacagccaaagaacaaaaaaaaatgcagcaacaggttgggcgcggtgtctcacgcctgtaatcccagcattttgggaggccgaggcaggcagatcatgaggttaggagttcaagaccagcctggccaatatggcgaaaccccatctctactaaaatacaaaaattagccgggagtggtggtgtgcacctgtagtcccagctactcaggaggctgaggcagaagaatcacttgaacccgggaggcagaggttgcagtgagccgagatcatgccactgcactccagcctgggcgacagagcgagactccatcttaaaaaaaaaaaaaaaaaaaaaaggtatacatcaccactaaatgatatagaaagactgaaaattaaaaaaaagaaaaccatatgtcaggcaagtactgacaaaattcaagctagtagagaactaataactttaggtaaacagaactcacaactttaagtgagcaaagagaaatatttaatgtggagaataattattatttactaaaaagttgcaacagtcatagccttcatgcacttacgaacatagctttgggccagttgtggtgggtcatgcctgtaatcccagcactttgggaggctgaggtggacagatcacctgaggtcgggagttcgagatcagactggccaacatgatgaaaccccatctctactaaaaatacaaaaaaaaaattagccgggcgaggtggtgcgtgcctgtaatcccagctactcaggaggctgaagcagaagaatcgcttaaacctgggaggtggaggttacagtgagcccagattacgctactgcactcactccagccttgggcgacagaacaagactctgtctcaaaaaaagaaaaaaaaaaaaaacaaaaacacatgatcatctcagctgacacagaaaaagcatcttacaaagttcaacatcctttattaataaacagtctcaacagtttgggtataaaatgaaaattcctggctgggcatgatggctcatgcctgcaatctcaatactttgggaggctgaggtgggaggatcacttgaggccagaaattggagaccagcctgggcaatgctgcaagaccccatcttgacaataattatttttaaattagccaggcatggtagcacatacctgtagtcccagttactcaggagattgaggcaggagaatcgcttggtcccagaaggtcagggctgcagtgagccataattgcaccattgcacttcagcctgggtgatagagtaaaactccatctcaaaaaaaaaaataggcagggcgcggtggctcacgcctgtaattcccacactttgagaggccaaggtgggcggatcatgaggtcaagagattgagaccatcctgatgaacatggtgaaaccctgtctctactaaaaatacaaaaaaaattagctgggcgtggtggtgcgtgcccatagtcccagctacttgggaggctgaggcaggagaatcacttgaactcggggggtggagattgcagtgagccgagatcgcgccactgcattcgcagcttggttggtgacagagtgaggctccatctaaaaaaaaaaaaaaaaagaggaaaattcctcaacatttgaaacatatggtatggtttggcactgtgtccctacgcaaatctcatgtcaaactgtaatccccacgtgtcagggaaggtacctggtgggaggtgggtggatcatgggggcagtttccccatgctgttcttaccatagggagtaagttctcatgagagctgatggtttaatagtgtggcacttcccctctcctcctgctgcttcaaaagatgtgccttgcttcccctttgccttccaccataattttaagtttcctgaggcctccccagccatgtgaaactgtgagtcaattaaacctctcttctttataaattactcagtctcagtaattactttataaattactcagttctttatagtagggtaaaaatggactaatacaacataataaaggctatttatgagaagcctgcagcgcacattatcatcaatggaaaaaacctaaaaacttttccactaagatctggtacaatgcaaggatcccaaacttaccacttctaatcaacatagattggaagaactagcaagtgcaattagataagaaaaagaaataaaagacatcaaaaatcagaaaggaagaggtaaaattatttctatttgcagatgacataattctatatgtagaaaaccccaaagattccacaaaaatatattagaaactagtaaatgaattcagtaaagttgcagagtacaaaaccaacatacaaaaatcagtagtgtttctatacacaaacaacaaatgagctaaaaaagaaatcaagaaggcaatctcatttacaatagctattaaaaaaacacctaggaataattttaagcatggatgtaaaagactgctacaaggaaaactacaaaacactgatggaagaaattgaagagggtacaaacaaatggaaagacatctcacttttcatggatcagaagaatcaatattattaaaatgaccatactactcaaaacaatctacagattcaatgcaatctctatcaaaataccaatgattttcttcacagaaataggaaaaaaatctcaaaatttttatggaaccacaaaggaacccaaatggccaaagcaatcccgaacaaaaagaacaaagctagaggcatcacactaacagtcttcaaaatatactacaaagctgtagtaaccaaaatagcatgatattgtcataaaaacagatagccagacaaatgaaacagcatagaggactcagaaattaatccatggatctacagccaactggttttttgacaaagatgtcaagaacactcactggggaaagaatagtctctttaataaatggtcctgggaaaactggatatccatatacagaagaatgaaactagatccctacatctccccctatataaaaaccttgtacgtgagtttatatataaatcaaaatggatcaaagacctaaatgtaagacagaaactataaaactactagaagaaaacataggggaaatggttccggacactggtctaggaaagattttatgaataagacctcaaaaatgcaggcaacaaaaacaaaaataaacatatgggattatatcaaactaaaaggcttctgcacaacaaaggaagcaatcaacatagtgaagaaacaacccagagaatgggagaaaatatttgcaaactattcatataacagggaattaatatctggaatacacacggaactcaaacatctcaacaacaaaattgtataaaaatggacaaataatctgaatagacacttctcaaaaagaagacatacaaatgaccaacaaatatatgaaaaaatgctcaccatcatcaatcatcagggaaatgcaaatctgcaaatcaaaaccactatgaggtataatctcaccccagttaggatggctattatcaagacagcaaacaacaaatgctggggaggatgtggagaaaaagaaactcttttttttttttttggtttctgttgcccaggcggcattgcagtggcatgatgatagctcactgcagcctcaatctcccaggctcaagcaatcctcccactcagcctcccaagtagctaggactacagacaagtgccatcacacccagctaatggttttgatttttagtagagatgaggtctcactatcttctccaggctggtattgaactcctaagctgaagagatcctcccacctcagcctcccaaagtgctgggattacaggtgtgagtcaccttgcccagccagaaaaagggactcatacactgttggtggaatgtaaactaatatatccactatggagaacagtgtggaagttcctcaaaaaaactacaaatagaactaccatatgatccagcaatcctactacttggcatttatccaaaggaaaagaaatcagtatatcaaagacacgtctgcatccccatgtttattgcagcactattcataatagccaagacatggaatcaacctaggtgtccaacagatgaatggataaagaaaatgtgggccagacgtagtggctcatgcctgtaatcccagcactttgagaggccgaggcaggtggatcacctgaggtcaggagttcgagactagcctgaccaacatggagaaaccccatctctactaaaaatacaaaattagctgggtatgttggcaggcgcctctaatcccagctactcgggaggctgaggcaggagaatcgcttgaacctaggaggcagaggttgcggtgagctgagatcatgccattgcactgcagcctgggcaacaagaacaaaattctgaaagaaagaaagaaggaaggaaggaagggtgatatatatatatatatatatatatatatatatatatatatatgtatgtatattctgtatgtgtatatatatatgtatattctgtatgtgtatatatatgtgtgtgtgtgcgtattcatatatatatacatacatacttacaatggaatactattcagccataaaaaagaatgaaatactgtaattcacagcaacacggatggaaatggaagacagtatattacgtgaataagccaggaacagtaagttaaatgccacatgttctcagtcatatgtcgaagctgaaaaatgttgatctcataggagtaaacagtagaacagaggatactaaaggttgggaagggtagcagggggaagggaaggagagaaagatatcttaaaggatacaaaattatagctagataggagcaataagttctagtgttctatacttactataggatgaggatagttaacaataatatattatatagtttcaaatagctagaaggagggtatgaaatcttcctaaaataaacatatgatgtttgggatgatggatatgctaattactccaaccactatacatttatatgtattaaaacatcactatgtatcccataaatatgtacagttactacatgtcatttaaaaataaaaattaaggttgggtatggtgactcacacctacaaacctagcactttgggggaccaaggcaagcggatacttgaggccaggagttgaagaccagcctgatcaacatggtgaagcactgtctgtactaaaaatacacacacatacacaaaaatagctgggcgtggagtcacacacctgtaatcacagctactggggaggctaaggcacaaaaattgtttgaaccctggaggtggaggttgcagtgagccatgatcgtgctactgcactccagcctgggcaacagagtgagactctgtctcaaaaaaacaaaaacaagaacaaaaaacaaaacacaccaacaaaaacaaaaaaaaataaatgaataaaaattaaaaaaaaatcaggctgggcatgctggctcatgcgtgtaatcccagcactttgggaggttgaggtgggaggatcgcttgagcccaggagtttaagaccagcctgggcaacacagcaagaccccatctttacaaaaagtttaaaaattagctaggtgtggtggtgcacacctatagactgagctatttgggaggctgagggaggaggatcacttgagtctgagaagtcaaggctgcagtgagttatgattgtgtcactgcactgaaacctgggtgacagagtgagaccttgtcttaaaaaacaaaacaacaaaatcacactggccagtcacagaaagaaatggcaataatgaaagttgccatccctgtctgacaaactagtctgtttcttctctaaaacaaattcgcaaaatgattaaactgggttgcaaaaagctgagggaagtttaaacagaatagctttgctatcatttggaaaaaagactgagtaaaagcttggtcaccctgacgtggctaatatttgtattgtaaatgcaactcagagtacattcttcataatatcagataaagaaaaatagtgtggaacgcgagttgtctgcgttactttcgtattctcacttctgctttggagaaggaagttcttttagcatgctaagagagacagttaatattcaaattaactggagaaaggtctctcctttgaagtctctagcttcgttagagatgatgctagacaccagcagaggtctgtatgaggaggaaaagggggcaacatgggaccggtgagtgcccatccgcggctaactggatacggactgagagatcacccaagagaaaagtgttttgcgccaccctctggactttttatgtatatttgatggctattaattgatactaatatgattgataatgaactacatcagcacaccacggcttgataatggatcccacgtgaataccattacagactttgagggacacagcaatgaggttacgcaataaatctaagtttctgggtacaagaaaccgaaacgatgggtgtcaaaacatatgcaaatagaactgaaactcagcaacgtacacattccaatctaataaatatcacctgaacttcgattaaaaatgaatgtaatctcggcagggcgcggtggctcacgcctgtaatcccagcactttgggaggccgaggcgggcggatcacgtgaggtcaggagattgagaccagcctgaccaacatggtgaaactctgtttctactaaaatacaaaaattagctggccttggtggtgcgtgcctgtaatcccaactcctcgggaggctgaggcaggagaatcgcttgaacccgggaggcggaggttgcactgagccgagatcctgccactgcactccagcctgggtgacagagccagactctgttcaaaaaattaaaaaaaaaaaaaaaaaaaagaaaagaaaaaaaatgaatgtaatctcctcttaagtggagcttttcaaaaattctgcgtttaaactccaagggcttcgttctgtgtcgtgtaaatagttggggagaggacagcaccattcacttaaatgtcaatgggaatcacatttaagtaaaaggaaaaggaaatcagtaaatcaaagtaaatcaaagacacatctgcatccccatgtttattgcagcttattccctgttggacgtcccctgaatttcctatagaggtgaagccatctctgccttaaggaaaaatgaagtgcctaatactgcttataatatggtcccttttccagatttagcttctccaccccagatttttgcacaagccatactgaactacttcatgtttccatactcatgttttgttccagccacactgaattacttaacattcagcacattgccaagctcttttcccccgcttccggggtttgcacaagttgttccctttgccaagcaaattcttccccacctccctactccttgcctaaactcttcttttgggcgtagaaagaagtattgcttctgggtaacctttgtctaataatgaaatatctaagacatattgagaacttactatgggtccctcactgttctaagttctttcacagagattcacttttataattatcaggaaaactggactttttttttttttttttttttttgagatggagtctcgctctgtcgtccaggctggagtgcagtggcgcgatctcggctcactgcaacctccgcctcccgggttcaagcgatcctcctgcagcctctcaagcagctgggatgacaagcgtgcgccaccacgcccgggtaatttttgtatttttagtagagacggcgtttcaccttgttggccaggctgatcttgaattcctgacctcaagtgatcctcccaccttggtctcccaaagtgctgggattacaggcatgagccacagcgcccggccaggattcacttttataattatcaggaaaactgtaggaagtgttaataggtaaaaggacctcatttcatagataaggaaactgagacacagagagagagggagtttctaaaagtgttatacaggtggcctataaactctgtagtgaagaaaggaaatgaagacaggatagaatgatcgcgagaaaatggtaagaacaagggactggaagacgcaaggaagtttagaaatacgctggcataggggtcttttgagcaggcacgctgctaagatgataggattatagtcaaggatggggagcgattgcactggggatttctggagcgggtgcagcctctgatggtaacatggtccagggtataccttcaaaacgggaggctactggagtgaaaggcgtcaatggtgataacactttaaaaaaaacttcagtgtttccctagcatccagcccagtatctgctaaattctttaaaatatctgttgaatgcatgtcgtgaacgccgtgctcatgggcaagccccagatgaagcctgtgcaagtgcttcttgctttaactcccttgtagcaatcagaggaacatcctctgcctaggattcccaagctccctgaacctcacgcgacagctggagcccaggctgcgtccgctttgaggttcatccgagcctgggcagttcggtccctggagggaattcgctttagatacgactgtcagagagaagtgtgctgataagaacactcgctcatagcgcgcaagcatcagaagtgggggaggccggggaggcgctgcgccggtgcctcaggccgtcctcggacacaggccctgagaagcgtgtccgtgtttcagagggtggcggcggcagctttgtctcagcgaaggccacagcactgcgggcagctgccgcatgaaacctcggctccccctgactctgcacccgacacttcacctgcaacgcaatccgaaggcgaaggcaccgcatcccgtcggccccgcgcggccggaagcctcgcgcccaagactccccggcatcctagcgcgctggctgcaaaagaggcgggaaacgcctccgcgtcccttccaacagtaccggagagggagaggggcgtggctgagactagccccgaccacgcgcgcgcggcccctcggcaaccggcacaacacaacaaaatggctgccgcgccgctgggcccctgaggaaagagcccgaacttctcccgctctacctcagcctgcgggactgctcggctcggcttctaggcggtgagcgtcagacctggccgagcccgttccccggcatccggcccgagcagtgggggccggcggcaaaggcgggaaggcccggaccgggcgtggtgtgggccggcttgggatggattcggggcgggggcgcgtgtctgggaattgggattggacgggaaagaggggagggcccggaacgggcgtggggcggtggatgaaggagggaggtttggatgggaagaggtggggacggcgggggcgattggggatgaagaaccagagtgtggggaggtgtggaagttagggtgcggcgcccagaaggttgtgggtcctgccacctgagctgaggggagagctgggatgtgccagctgtctgtggggagtgagcgggagaaaggacagtttgggcgtcctgacgggttgtcacggtatcggacggagtacagtgcgtggagaaagatgacaggatatggggacgaaatgctaaaagaaggggaagaacaaacacttccgttatattcgttaagggactagagaattttgaagccagacaaacttgggttgaagcctcaattctgccaccttgtgtaacttaaccaggtctgtgaccctggatatgtgtctgagccttcctgatcatgtttcctcatttgtccaaataattgcgaatcatttttgggtgttcactatttgtcagatccagttttaagcactttgcacgtattaacctcatttagaatttaaaataacttgtatgaggttatcatccccatttaaaaagtgatagcactgaggaccagagaggttaagtaatttgcctaagatcacacagtaagtggaaaatcagaatttgaactcaggctgtttcgttccagaatccaagcttttaactgttcaggtacattgccatttgtaaatcaggttaataattctgatcctatacagctaaatctttgaggatttaaatttggtattgtctaagtgtttagtacagtccttcagtcaacaaatatttattgtttatagaacaacagacaaaacctctgctctcttgtagcttatagtctagaaggagaaacaggcaacaaccaagtagtttcacaaataatggttataaaatgctatgaaggagactgcttggtgcagagatcatgggtaatagggagataaaatcttctgcatcttgagcttagattctagcatggttcttcctacataaaagttgctcaataaaattgaataattaatggaaagagatgggaagcttgagttttagggtatctgagcagaagaagagagatgggagaggggattcaggcttttaataggatggagaaggatacgggggctagagtattaggatggaaaggcaaataggcaggcagttgggttgggatgaagaggaatggatggaggtttgagtattttgtttagggaggggagtaattggaggtcagagtattggaacgcattaggatgtcagggtattttctggggtgaagagagatgagcagcttgggaagtctggatggatagagaaatgttgagtctgggcacaggaaagaaccatagagaaatgggggagactattactgtgttagggaactgggatagaatttgtgggaaaattggcaatcagaatgggataaagaagaatgggaggcagaggtgggtgggcagcacagaatgggggaattggctttggaaagaaaaatggctggagactttgcagaggaatcggaatcaggatatttgaaaggaggagaagattaaggagtaaaagtatttcagtaggtcagagggtatgggatgaagtagacttggaaagtactgaaatccaattaaagggctaaggagagggatatgggggttaataaatggggatgggtatttgcatattagggagtctgtagagagacagaaggaggtctgcgttatttggagatcagagaagatgggaagttaggaaggttaggaaaggctggatggaggtggagtttgcagtctgtactaagctgtgatggactgaattgttagatcagagcaactatctgggtttataggtggcaggatgggtagtgttttgttgcctggacgtaggattctgattatcatgtcattccaatggctttctcttgctctgcagacagcctttaaaatacaactgcagctctgaactttatttgctttttttttctctttatcctgctcctttactcgccctagcctacctctcagttgtcttcatttttccattgcttgcttggtctttgttcatgtgattgcaaacaacatcctagatcaaactacatcctcatctctccattaaaattataattcagcatttaccacctccaggcagtagcctaagaaataatgccagccattctcaaacactgtaaacccctaagcccacttcactgagttagctattctctgagactgattacgtctatcttgtttcagtgtccaagctttacagaagctgtggcaaccaagggtttaagtctatgaatgagtaagcctgacttttactaatcaggagaggtaataaaggacctcatgatagtctggtgagacctaaagggtcttgatcattaggatgtaaaaactacaggctgggcacagtggctcacacctgtaatcccagcactttgggaggctgaggcaggaggatcacttgagcccaggagttcaagaccaacctgggaactatagtgagaccccccatctctacaaaaaataaaaaattagccaagcgtggttatatgcgcctgtagtcccagctactcaggaggctgaggtaggaggatcacttgagcccaggaaggcaaggttgctgtgagccatgagcatgccactacactccagcctgggtgacagagaaagaccttgcctcaggggggaaaaaaacgccaactacgtactatacatactataataaatgtcatcttttaatccatttaattaggaataagattttacctaagcacatgcctcttagcttttctcaaattttagagtattatccttatttagaaggagaatgccagtgcagcttagcagcatcaatagtattactgagggctgggcatggtggctgtaatcccagcactttgggaggccgaggtgggtggatcacctgaggtcagaagtttgagaccagcctggccagcatggcaaaacctcatctctactaaaaataaaaaaaattagccgggcgtggtgctgtgcacctgtaatcccagttactcagtaggttggggcgggacaatcacttgaacctgggaggcggaggttatagtgagccgagatcacaccaccgcactccagcctgggcaacagagcaggactctgtctcaaaaaaagaaaaaaatagtattactgagactacagattaaactcaatttctcccactatacgctcacaacatgattccgtaggattttcccccacacattaagcaagcagttagttctgcagtggtgggcaccacaggactgtcctctagttcagttcaattctgacactgtctacctggagacagcgtcacatccctaaggttgaaggctggcttacaagactgcccccaagttctgatgccaactgtaagcctcagttttacctgtgcttctgactgaccagctataaatcagagttcccacaactccctccttgggtttgattaatttgctagagcagctcacagaattcagggagcacttacttacatttactggtttattataaaagatattacaaaggatataggtgaaaagatgcatagcgtaaggcaggtgggaaggggcgtagagcttccacaccctctctgggtggattcccctccaggaccctccctgtgtccagctttctggaggctccccaaacccagtcttttaactttttatggaggcttcattatgtaggcctgattgattacatcattggccattggtgatcaactcaacctttagcccctctcccctccctctttctagtgaccagccacgatcctgaagctgcctagaggtggctagccatcagtcaactcattagtatacaaaaagacacttacgatagcaaaagggactaagactaagtatgtatttcataatattaaaattactaaaagacttttttccatggcaaaattgtgttataaggcacaaaaattgtttaccacgcttgaaatttagaccaaaaagccttgtggaaatggcataaatagcagttatgtaacttgggggagtttttctgatccatatgtatagtttaatatgagaaaatgaaggaaaaagtacagatacatttaagttcacagtttgaagtacaggttgaaggccaggtgtggtagctcatgcctgtaatcctaacactttgggaggtagaggtgggaggattgcttgagctcaggagttcgagatcagcctggacaacatagtgaaacgctgcctccaaaaaaataaaaataaagtacaggttgattatctcttgtccaaaatgcttgctatcaaaagtgtcttggattttggattttttcggattttggaatatttgctttatacttgtttatattttttacatttatatttaaatatttcagattttcagatttggagtgcttaacctgtagtgaatgaggctattggaatggggcatttggctatattgtaatgtatgtgaaataataatcaactttttaaaaacaaaaaaagacggggtttttattcctttcaaactactcaccttgagagaccggatcatgatatcagagatcctttctttgtataaaattttctgggtttccttcaggattttttttgttttgtttttttgagatgaagtctcactctgttgcccagggtggagcgcaggggcacgatcttggctcatcgcaacctccacctccccagttcaagtgatttttgttcctcaacctcccaagtagctgggattacaggcacctgccgcccatggcatcatgctaggccatagagaacaaaggaaacataatctagactccaggaaactcagatagctatatgacatggtcattaaaaacatgggttttgaattaaatcacatttcaagttttggctaaaccaattagttaaggaattttggacaaattatttaagatcttcatctgtaaaatgggaaataacacttatctcatagagttgttgtattcaattctttcaatatgatgatacacataaagagcttatcacaacatatatttgtctgtctgttttttagagacaggggctccctgtgtttcccaggctgcagtgcagtggccagtcacaaggttgatcatagcacattgtagcctggagctcctgggatcaagcaatcctcctgcctcatcctctggagtaactgggactgcaagtatacataccgtgcctgacgaaatatcacaatatttggtgcgtggtaagccctcagtaaatgttagccactagtatgatattctttagaattaacttcaatcatcatcttttcattaaatttttggaagtagacaaaattcatatggagtcaaatttactgagtaaggttagtgatcaaactgggaaaataaaaacaaagtgtacctgaagcgatggacccgattttcttgtgagacttaagaattagtttgaaagcagaatccaaagaggaattccaaaaattgaatatattaatagattatattagtgtaatctctcctttatatactgtataagttctgtaggggaggaaagggagtaattcctttctggcccatcataaaggtcatggccaacacccctgtaacaaagacaggttgactagagaaaagcatagcaaatttattcgatcaaagctttatgtgtcatgggagccttcagaatgaagacccaaaaaatgcagaaaaaattatccgtttttatgcttaggattagtgaagtgtggacagctgtatagaaataggattggacaaaatgggtatgatctaacgctaatagactgagtgaggaaactcagcaacacctacctctccagatttctcttggcctctctgtgcagcattccttcctcctgggtattgggtaggacccctatggaatgagagtcttaatttctttatggccagctgttagaaagctgggagtttgcaggaagtttctgtataatcacagcttatatgtacccatatgcttgtgaagttatattatcttttaatagagatatgaaaaactcaaaatgttcttcctactgccgtaccacacagtacaatacttgtgacatcagacatgtaagggttgttgccccatacaccagatacttcttcagtggacaccagctgcatgtcctcttattcagttcaattctgacactgtctgcctgaagatagcatcagatcccacaggttaaggactcagtcccacaagagtgccaccaacttcagatgcccattacaagtagtagattgccacctatacttctgaccaccaagctataaattgggactcccactgccccctccttgggttcaattaatttgcttgagtgggtcacagaactcagagaaatactacttacattttcccatttattataaaggatattacaaaataaacagccagaggaagagttgcatagggcaaggtacgtggaaaggggtatgaagttttcatgctctcgccagcatgccatcttccagacacctccacatgttcagctaattggaagttctctggaccctgtccttttggggttttatggaggcttacttatgtaggcgtgattgctcacatcattggctactggttatcaaatcaattttagctgctctcccctccttaaaggttgtggggttgggcttaaagtcccaaccctctaaacatgccttagtctttctggtgactggcccccatcccaaagctgtctgggtgtcaccagtcatcttattagtaaacgaaagacactcttatcactgtggagaacccaaaggttttaagagctatgtgataggaaacaggaggaacatcaaatatataggttaaaagagaaattatcaacacattaaatttaacagtttaattgaacaaagaatagttcacaaattgggcagccctcagaaccagaagagattcagagagatccattctgcaatgtaggcaggcagcatttatggatagaaaagggaagtgaggtacagaaatagcttgattggttatagctctgtgtttaccttatttgaacatggtacgatcacttgactgcctgtgattgaagctcagctgctatgattggctgagactcagctattacaaaaacatactcctaagttaggctttcagttagtttaccttctaagttaggttgcagttcattatgtagagacttaaagtacagaggcactttcaggcaaaatttagtttaatttaacatacagtcatgtgtcccttaatgacagaatttgctctgtaagatgcgttgttagacaatttcatcattgtacaaacatcatagaatgtacttacacaaacctagatggtataggatagcctgttgctcctagactacaaacctgtacagcatgttactgtactgaatactttaggcagttgtagcaccatggtaaatatttgtgcatctaaacatagaaaaggggctgggtgtggtggctcacacttgtaatcccagcactttgggaggccaaggcacgtggatcacaaggtcaggagttcgagaccagcctggccaatatggtgaaaccccgtctctactaaaaataccaaaattagccaggcgtggtggcacgtgcctgtagtcccagctactcaggaggctgaggcaggagaatcgcttgaacccaggaggtggaggtttcagtgagccgagatcgtgccactgcacaccagcctgggcgacagagggagactccctctcaaaaaaaaaaaaaaaaatagaaaaagtacaataaaaatatggtataaaatgtaaaaaaagtatacctgtatagagcacttaccagatgaatggagcttgcaggactggaagtttctttcccagttagtcggtgagtgaatgtgaaggtgtaggacattacggtacactactgtagactttataaacactgtacacttaggctacactaaatttattaaacattttttctctcttcaatagtaaattagccttagcttgctgtaatgtttttactttataaactttaaactttttaaaaactttttgactgttgtagtaaaacttagcttaaaacaaacacattgtacagttgtacaaaattaatttctttataaccttattctataagcttttttctattttaaaaacttttttactttttaaatgttttcttaaaaactgagacgcaaacacacacattagcctaggcctgtaagggtcaggatcatcagtatgactgcctttcatatcttgttccactggaaggtcttcaagggcaataacatgcatggagctgtcatttcttatgataacagtgttatgttctggaatacctcttgaaggacctacctgcctgagtctgttttatagttaactattttttaaaaaataaatagaaggagtacactctaacaatgaaaagtatggtatagtaaatacataagccagtaacacggacatttattaccaagtactatgtactctacataattgtatgtgccaggcttgtgtacaccttgtagcacagtaggtttgtttacaccaacatcactacaaacatgtgagtaatgtgtagcactatgacattatgacatatatgatgttactaagttataggaatttttcagctttattataatcttacgggaccactgtcatgtatgtggtccgttgttgaccaaaacattgttatgtgatgcgtgactgtatgtatttcacaatatcacatatatgaagatgtttgtcattccactatccctttctaatatcaatttatatagcattaagacttgagctactctaaatccttggattaaaaactactttaacctaatatcttatttcattaaattttttttctaaaaaataatttctgttttcacattttcagcagtgactataggggaaattaaggtactaagcaaagatagcatcattattaatgtagccttgctcgagatctatacatcttataatattttttgtccaaaagtttgtaaagtttataatttttgtactgtttttagactaaatgtacttataagaacaactgtgtatcatgaaaatcatttttgcatacacctaaccttgcaaatgtaggactcttgatgttaaggactagtattgctcatgcagacattttttgttgagatactaactagtacattttacattttatgttatttatgattaactcattcaataaatgttaattatttaccatttgctaggctctgttcgaggcctacagtgtgctatatactgtacgcacactgtaggcacagcacactgtatgcctaggatagaagaggatgtcattttttttttttttgtgagatggagtctcgctttgtcacccaggctggagtgcagtggcgcgatcttggctcactgcaagctccgcctcccaggttcaagctattcttctgccttgacctcctgagcacctgggattcctggcgcttgccaccacgcctggctaatgttttgtatttttagtagagacggggtttcaccatgttagccaggatggtctcgatctcctgacctcgtgatctgcccgcctcagcctctcaaagtgctgggattacaggcatgagccactatgcccggctgaggatgtaatttttaaggactaatcaagtcacagtgctaaaccattctgagccttaatggtcatgaactttacctttctttcatataggaaaagaaatatttttatatgaaaacatttaaaggaatttgaccaaggtctctttcattaacaaatgctttagttccttctggaagatctatacttcaataaaattgattttgtaaataagaatagtagacactgaagtttgaagtgatcagatgtttttcatatagcatgagacaaatatgaatggatttcagaaacgatatttaacaaaaaaggcagatttaaaagatattttatggtttcatttctctaaagttcaaaaatagttcaaaaatctctggtgttggaagtcaggatggtgattccccatgtgtgggagttagtgactggaagggggcatgagacgacttctgggattctggaaatattctgtttctttacctggatgctgattacatagcttgtgttcactgcatagaaattcatgaagctatatacacttatgatttatgtactttatgtatgatacattgcaataaaaaatatgcatacagagagagagagagagcacatgcatgaaagagcacactgttgaaagtatggtttttaaacagggtgaattctagttataagatgttagatgtattcatgacctagacaccatggagctgctgggaattcagagattacttctccacttgtggttgttacattctgagcaagcaaaagatatatagtaggtatattcagtgtaataaacagggaggattcattctgtaggaagaaagtagatttctggaaagtcttcacaagaaaagtaacagtttaattggttgagagaaataagaggatgtttaattccctttaacgaattccctttaaggaaagggaatttcatgagcaaaaactcatgatgtgttcaggcaatgacaaaaagatgactagagcaatggtatgtggtggggaggccagaaagtttgggccagactgtgatgagtcctgtttgtagtgcatggtgccaaaatgtttagactcataggcattgggaaccattacatttcttttgtttttattatataagtgggtcaaaggtagaggatggattgaggataaaggagaactggaaggaaggtggttctgagagtatcttaatagtctaagcaagagaggataaaagttgaatctagggcagtagctgtgacgatggatagagacgaatttcaaaatattttggagatagaatcaatattgttggacgatggagagggatgactggaagataactctattcattcatttattcaacaaatatgtattgagttcctgctaggtaccaggcactatgctagactcgggagacagtgtaaacaaaacagacaggctctcgtggagcatacagttcagaatggagacaaatgttaagcaaaatgacataaatgtgtaatttcaaactgattatgtgaggaaaaaatacaaattcattgagagtatagaaccggggacttcacttcatctgccctgcactggaggctttcctgaagaagcaacagttgagctgatctctgaaggaagactacaaattaacatggtaaaaagaatgagatcaagcattattattactgtgaggaggccagtgtgactggagcccacaattgagggaacgaatgacagaggtgaatctagagcaatagggacagatcatgggggaccaccttgtaggtcatggtaaagatttccttcattacagactgctggatttacttttttttttttttttttttttcctgagatggagtctcgctctgtttcccaggctggactgcagtggcgcgatctaggctcactgcagcttctgcctcctgggttcaagagattctgttgcctcagcctcctcccctcgaccccaagtagctgggattacaggtgcatgccaccacacctagctaatttttgtatttctagtagagacggggttttgccatgttggccaggctggtctcaaactcctgacctcagatgatccacctgactcggcctcccaaagtgcggggattataggcatgagccaccgctcctggactggatttactttttaaatagatcactctggctatctgactgcaatgtaatgatggaagaataaggcaagagagcttgtagacagatcagttagaagctgttatagtagtttgatgagggcttggattagagtgcgtgagagtgaaaatggaaagaagcagacttaatttgagaggttatttgggagtaagaattaacaggatttagcgattgactgagtatgggacaagggaagagggaggtgtcaggaatgactcccaggtttttggcttattccagcgagcagtgttcagtatttagggaacactggaagacgaaaaggagagtgagaggaggaacggggtaaataaattcaatctggactgagtgtaggatgccaatgagatatcacgtaggcaattggaaataggagtctggagctcagagaaagattggattgaggttataaatatcggctgggcatgatggctcacacccatatgtaatcccagcactttgggaggccaaggcacgtggatcacctgaggtcaggagttcgagatcagcctggccaacatggcgaaaccccatctctactaaaagtacaaaaattagccgggcatggtgacaggcgccaggaatcccagctgctcgggaggtcgaggcagaagaatagcttgaacctgggaggcagaggttgcagtgagccgagatcgcaccattgcactccagcctgggcgacaagagtgagattctgtctcaaaaaaaataaaaaattaaatagagtaaacacatggcattgggaaccatgggtgtgcattaatttgtccaagataagattagacagaaactagaagggaccaatgaggagttctgatgtttaaattacactgcaaggaggaacaaaagccagcaaaggagtccatggagtggccagggaggcaggaggataccaggagaatgcggtgtcccagaaaccaaaggaagaaactttgaggaaggagagagtgctcatcagtattaaatactgctggttgccaaatattccagcttcctgcattctaggaccccgttatgtgggtaaaaggggccttgggactagtttggttcaataaacagaacaggaatgacaacacttccagctggagcatgtgtcaattctatcccctctggagatcccttttctctctggcaaggtcatcagtgatgtttgatacagtgtctgctccatcagcttggagtagtatgggtcctagcatttatggcctctgagtttataactttatagacctgaaggttctagaaagaatagttttgataactcttaaaaattaatcttgttgaatatactgaaaactcttacaggttttgatgaacacctggctttattcttgcaatgaagaaaggttctcaacaaaaaatattctccaaagcaaagataccatcatcatctcactctcctatcccatcatctatgtccaatatgagatctaggtcactttcacctttgattggatcagagactctaccttttcattctggaggacagtggtgtgagcaagttgagattgcagatgaaaacaatatgcttttggactatcaagaccataaaggtatcactttttaatctaagaattggtctgaccacatacttcaagtagagatggaaaattttcggcttgcatttttggtccaactgtaacattctggtactaatttgatctattgtttttattaacagaaattaaggactgtaaggacagttggaggattgaggtttctgggtgagggtaaagatgtcagtggattcaaagagggagttttcagaaagaggaagctttgtttcctgtggtaggagagtgtcttaaaactcatcccaaaacttgccatcctctttggttaaggggagggaagatctgttcacttcagagtggagcgccttaattcagtaaaaaaacgttatacatacttggcctatgccagtcttcttattagcaaactgcttatctgtgaatggactgatttccacatatgggacatgtatgtatgttccactagtgttttagttttttcttaaaatcatctgttagtctaggaatctgttctcaaaagtgcattgttgggggtatagcttagtggtagagcatttaacttcaaaagtaagttattctttggtaagtcatgaaataatagccattaaactctaatcaggttttattagcattaacaacactgagtttatactatatctttgctgcaagttggcatattgttatttctaatttgattaatattttagaatgttatcaaatttagaatattaatcaattttctttccaagaacaagccaagttaaatttaaatatctttttattttgcaccaaaataaatttaatactaacttgtaaataatcttagagaatctttggctcacagcctggatctcaacccaggattaattttttctgactcgtaaggcaggaaccaagaggtgatttactttttagggctacttttgtaaaatgtaatgtggcattaacagtctttgacaacaatatccaggaaagttataagaccagatttgccatccatcaagtgactgctctagctctataaaatatgttgtgattttctctatttaaaagtgcaacaaatttagagtttcttaccataaaaaaataggaaaagaggatttttaagaatttcagtgtttctgaactttagattggaattttctaaaaaaacaaacaactaagtattaccagtttatttttaaaaactaacacgaaaatattgctgaaaacttcatatagttaaaagtgcaagttttatattcctctgactggattcaagttctggatttgtgccttaattagctgtaggatcttgagcaaatgattttttttagtaagtgatgatattaataatttctatctcaaaggtttgttgtataaattaaattttaaaaatgtaaaccacttagcccaaagcttggcacacaccaaatatttatagtgtgtataaccattatcatctttgtatcattatagttactacattacaatacgttatagtattacaatacattaattgtaatatacaatacattatagttattacattataatacattatagtattacaatcattacatcattatttcattataattatgaaatgctatgaagtaaaatattattaaaacattatgattagaaatagccagcttttttggtatattcatggcttaatttttgtttttgttacataacatcaaaacaacttgttctttgtgatattcatgtctttcctctactgatgatgatctgtttctataatttcaggagctgattcacatgcaggagttagatatattacagaggccctcattaaaaaacttactaaacaggataatttggctttgataaaatctctgaacctttcactttctaaagacggtggcaagaaatttaaggtaggttaccaacaatttctgagcatagatactgtttttaacttttctgtgctttaatactgcgaaaaaaaattatcctaatgtcacctaatttgtggcagaccttttattgtttccagtgaatgttctaaatcagaagtatatgacatttccaaattaataagtttctattactcaatattcttacaacattgactctgtagagaaggggttggcaaagtacagcttacaggccagatcaggccagctatctatttttgtaagtaaagttttattggaacacagtcacccttatttgtttacatattgtctgtggttgtttttgcactacagtagcagagcttagtagttgccacagactatatggcccgcaaagccaaaaacatttactatttggcctttgtattcgttcattttcatgctgctgataaagacatacccaagactgggcaatttacaaaagaaagaggtttaattggacttacagtttcacgtggctggggaagcctcacaatcgtggtggaaggcaaagaggagcaagtcacgtcttacatggatggcagcaggcctaaagagagcttgtgaaggaaaactcccccttataataaccaccagatcttgtgagacttactatcacgagaacagtaggggaaggacctgcccccatgattcaattatctcccactgggtccctcccacaacacatgggaattcaagatgagatttgggtggggacacagctaaaccatatcagccttttacagaaaatgtttgctaattcctgctctagagtgtttacagcttcattcataaactatacaacatgaacacattataatagacaacttaattcctttaattggaagaaaaaaaccttagatttctaccacgtattattcacaaaaagtatttccagaagggtgaagaactaaatgaaaacaaagcaaaatgaaaacaccaagtaacagaaatgctataaaagtattagagagagtatatgagaatatttttaaaatcttagagtggtgaaggtccccctaagcaaatactaaccctagtaccacaaaggaaaaatattgacagatttagcctgcataagacttaaacattgtgtttaatgaaagatgtattttaataagttaaaagaaaagcagcagccgggcgcagtggctcacacctgtaatcccagcactttgggaggccgaggtgggcagatcacctgaggtcaggagtttgagaccagcctgggcaacatgatgaaaccccatctctactaaaaataccaaaaattagccaggcgtagtggcgggcgcctgtaatcccagctactcaggaggctgagataggagaatcacttgaacccaggaggtggaggttgcagtgagccaagatcgcgccattgtactctagcctgggcaacctagatgttcatacagctggcttcttgttgttaaggtctcaacttagtgaggtcttctcttttttttttttttttttttttgagacagggtctcactctgtcatctaggccgatgccctctcttaccacccaatcacaattagtcaccctctcctcagtcgcactctcattcttttagtcaacaagtatttatttagcaccaggcagtaatgctagagtagtgaaacacaacgggcaaaatatatatatttatatataaatataaatatatacatattttatagatttttatagcaaacatgtattgcttatatatttatatatgcttatatataaatatatacatattttatagattttatagcaaacaagatcttcagaaaataaacagtgctaaaaaggaaataaagacatcttgtgacagaatgcaaggcaccaacagggcagattttgcccattgtgttcactactctagcattactgcctggtgctaaataaatacttacttgttgactaaaagaatgagagtgcgactgaggagagggtgactaattgtgattgggtggtaagagaaggcatcagcctagatgacagagtgagatatagatagatagatagataatatatatctatatatatataatatatatctatatatataatatatatctatatatataatatatatctatatatataatatatatctatatatattatatatatctatatatataatatatatctatatatataatatatatctatatatataatatatatctatatatattatatatatctatatatataatatatatctatatataatatatatctatatatataatatatatctatatatataatatatatctatatatataatatatatctatatatatataatatatatctatatataatatatatctatatatattatatatatctatatagatatgtaatatatatatctatatatatatatatttttttttttttggagtctcgctctcttgccaggctggagtgcaatggcgtgatctcggctcactgcaacatcctactccctggttcaagggattttcctgccttagcctcctgagtagctgggattacaggcacgtgctacgacgcccagctaatttttttttatctttagtagagacagggtttcaccatgttggccaggatggtctcgatctcctgaccttgtgatctcccctcctcggcttcccaaagtgttgggattacaggcatgagccaccgcgccctgccatatatttatttgtttattgtctgtttctgtgattgagaacaagaactttgttttctttattcactactttgtttccagtacctagaacagctcctggcccataatccatgtttgataaatatttgtggaatgggtgaatgaattataatcttggagagaaccatttgatgtggtagaagatatattgccttaccaatacaggttgagcatcccaaatccaaaaatctgcaatgctccaaaatccaaaactttttgagcactgacctgatgctcaaggaaaatgctcatttgagcatttttgggttttggattttttgatttgtgttgcttaaccagtaagtataatgcaaatatttcaaaacaaatctgaaatctgaaactctttaggtcccaagcattttgaataaggtatagtcaacctgtagaataggaatgaatggaagacagaatgaacaaatgtagacaattcgtgtgagaacattggtggtagataaggaagataagatgatagcttcatagtaaaacaagtttagtcctaggtgatttatatagaagaaatctgaacatattgaatataaactctgggcagcagggaagaattatctagttcacgccatattcccattacctggtgcaatgcctcatatgtagtaagtgtgtaatgaatatatgttggaaaatgactgcttttaaacttgaggggaagatccaggagggagaaagaggttgaatttgcaagggcattgggggaggaggtgagatcatgcaagagcataagtacttgatttaacttgaaaaagaagacattgtggctgacatggtgaaaccccatctctactaaaaatacaaaaaattaaccaggctaggtgggacgcgcctgtggtcccagctactcgggaggctgaggcaggagaatcgcttgaacccgagaggcagaggttgcagtgagccaagattgcgccactgcactccagcctggccaacagcgagactcggtccccgccccctccccacccccgcaaaaaaaaagaaaaagaagaaagctatctctcttagtctcttagtccattttctgctgctgtaacagactaccacagactgggtaatttataaagagtaaagatttctttggctcaccgttctggaggctgggaagttcaagattgaggtgctgcatctagggagggccttcttgctgcgtcatgacatggtagaaggcatcccatagtgaggcagagcaagagagcaaaagatcctgagacacagagagaaaaaggagactgaactgtgataattaatccactcccaagataatggcattaattcattcctgagggcagaaccctcataacctaatcaccacatgaaggtctcgcctctcagaactgtcacaatggcagttaaattcaacatgagctttggaggggacactaaaaccatagcactatcttttggaagaaaggaggggaatgagagggagaggtatggcaaaagtgaggtagagggaatgacagtgagggaaatcttgttggatagtcttgagcttcttagtatatagacaatgttgttgtcaactgaagggcaaagagagtttggtagcttgagtagagttattactcctagtcaaggagagctgcatcaagggattctccaggagagcagtaagggtatattattttctgatgactgatcaaacagaccctgatgcacataagtaaatgttgtactttatgtcaagtcatctgttgtgtaaagtattcattcatttgtttccaattagtatattgagaatttggaaaaatgtgttaaacttgaagtactgaatctcagctataatctaatagggaagattgaaaagttggacaagctgttaaaattacgtgaactcaacttatcatataacaaaatcaggtgagttatataacaaaatctttaggcagcattgcagatagctttgttagagaggtagattaatgttatccacattactgaaagaatgatttgacagaaacagaagatatttttatctttattcatcaatcaaatgaatgtctgtctcttcacatatggtaggtaactgtctttatgttttggcattactgaagtacagaataacatctagcattatcaaagagatatatttttgagcaccaaattgtatcttaatttcatttctgacaggaagttttcccagatattgtctgtgatttattaccttattacattaagaatgttgacatgaagcagaatgttttaaccctgccattttgacccccaagatgttctaatctgttttgattctgatgttctttgcttattgctacaagaaatatgctctcaatcctgtttccaattcataatatatattactgtgagaaataaacatactaaaactgacactggctaaaacttcatatagaaaacttgttatagacaaaatgatacaagaatcaaatcttgaaattcttaatatctgcatgcttttcccccaagttagacttggtaaatatgatggccaagaaaatgactagcaatggcagaagttctgatatgacaaaactgaaatgaaaaaaaatgattaatgaaccaaacccttattataaaatttgtataaaaagttgactctgatgaaaatattttcagcaaaataaaattgaaagtagagaagcttagaaatatttacccagtgtagatagaggctttgaagtatttgtgcagtatagaaaattgaccaaagaattaaattgacaaataaattagaagtgacttgggaaaaaccttcatcaatcagaattcattaatatgtgtgataaatgctttatttaaaagttctggttaaattacttatattcctaaatacagtatcatctatgggctcccatatcctgctggcatagctaatctttttatgataacttaagacaataattaggaacatcttttggacaggaatgtagcagataggacagggtgctattgagtttcccaggtctccactggctgtttgctagtactgttcacagtagtcggtgagaatgccatggtcacatttttcttttctatgttatggagttgcaaagtctaataataagattgataggattcctgggcatagtaataaaaagttggcagtttagctgttctggtaaatttggctttagccacttttctttgttctcatttatgaaaagagttgataaattatcattatgaaaagtaatctaacatggagctaaagctgtttattctaaaaatacaatggagagactctataattgtactcactaaattttattttatcctttgctttccagcaaaattgaaggcatagaaaatatgtgtaatctgcaaaagcttaaccttgcaggaaatgaaattgagcatattccagtatggttagggaagaagttaaaatctttgcgagtcctcaatttgaaaggcaacaagatatcatcggtaagttattcaaaatagcaggaatttttagacttgttaaaaaataaaagattaaaaatatctaagttttttaaaaatgggatttcttcttttaaagattttgctcctttgactaaacactagattcagacatagcccatgattttctagattaattaaatacaagcagtcctcattttgcatgggttcctaggtcaacctagggttgacctcttagcatttttacatttatcatttcatgtaagcctcataacattcttgttaagaaggcagtacaaggattatttttgtaacactatgagttaggtagtagcaagtaaggtctaggacaggttaagtcccttatctagagtcacattttgtgccaggatccagatcactgaatgcctagaagaaagttctgggtttttttttttttgacagtattaacttccaatttcaaatttaccagtttattttgattataatgttaggtgttataggaggttgatcactagcttttcataatagagcaactttgttatgatttacatatttggatgatgttgtatatttttctctggaatatagtttatgattttcttatggtatttattcacagctaggtatttaataagcatttgcttagtaaatttgttaatttatttaaatttgtattaaaattgggaaaattgtgccataatttaatgaacatcagttgtagaatagaaaatgaaagatgtgacttcaaagatgggcctctatagaattgccttccatgaccttggagaattctttaatccctctaaaaccactgtttggggaaaacaatccctatactgcctcctttacaggggtattatgggggctcagatgaaatgatagatgtgaaaatgctttaaaaaaaactttaaaacactaaataagtctaaagctatattctttaagccttcaccagtggaggccaataataataagcaatattcatttaatgccatgttgttaacaatacctatgctttctaatttcatcctgtgacagtcaagagcctcagagcccaagcccaaccccatgttgtacagcatcaccttggggctgttgatgctatgggatgatgggaagaggtagccatagatctaaaatttgccataaatattcctgaagtagttgatccttagatagtgtcaacttagtgtcagctgtgcaataggaaaatcaataaatatttatttctaattttgtatgatgtcctcaccccattgatatttgacattggcattatgaagagtgctgcacattcacttgggagagaagatttatttgtactagctatttggagtactgtttctcagcctttttaggttgagaataaactatctgaataaactgtcaattatagcacagttatctgaagatttaccaaaatattttttataactattcatttttttgatttgttaaatcagtataatgaaaagacaaagttgagagttacacaaacttgaattcaaatcctgtttcattcacttacaaggctttgagctttgggcaagtcgcctaacttctttgatcctgaatttcttcatctgtaaaattaagatgatacttacatgataagttgttgtgaggagtcacaaatgaaatagtgtatggaaaatacctaatactgcccaaatacactataaatactcatatactccctttcctgacaccactacttttgggtaattggcttcatgaatagattccttgccatgttaaatttccttgatttgtaacttcctttaagtatgttatgatttttaaattaaattataccaatactaatgttatatcatttcagctccaagatataagcaagttgaaaccgcttcaagatttgatttctctgatcctagttgaaaatccagttgtgacccttcctcattacctccagtttaccattttccacctccgttcattggaaagtttggaaggtcagccagtaaccactcaggatagacaggaggcttttgagagattcagtttaggtaagattaaatttaaaaaataataaatttgggtgagggaggaatttattttcagaagttatctagaaatatgtatcatgaactttataatgctattaaaatgtacatgggaaatggcagcataaatcaattcaacaaatatttactgagtgtgtactgtgcaccaggcaactggatttggcactaaggatacaatgggaaggaagacatatggtgctgctgtccatgcagcttatgttttggcagagaagacagacaaaaaaaaaaacaaaaacaaagtaacaggggaaccctctttgtggcatagaggaatggctttctgagggagtgacatttaacccgaaagcaaagagaagagagggttagccatgtgaagaatggcagtaaggggagggagcagcttgttctttgaggctcaaaagaccctgtgagtttaaggaagtgaaagaagattagagttaaacgtccctgactgacagctttgaagagagtagtggttctcccagcacggagtttgagatctgagaatggacagactgcctcctcaagtgggtccctgacccccgagtagcctaactgggaggcatctcccagtaggggctggctgatagtgcccctctgagacgaagcttccagaggaacaatcaggcagcaacatttgccgttctgcaatatatgccgttctgcagcctccactggtgatacccaggcaaacagggtctggagtggacctccagcgaactccaacagacctgcagctcagggtcctgactgttagaaggaaaactaacaaacagaaaggatatccacaccaaaaccctatctgtacgtcaccatcatcaaagaccaaaggtagataaaaccacaaagatggggagaaaccagagcagaaaagctgaaaattctaaaaatcagagcgcctgttctcctccaaaggaatgcagctcctcaccagcaatggaacaaagatggatggagaatgactttaacgagttgaaagaagaaggcttcagaagatcggtaataacaaacttctccgagctaaaggaggatgtttgaacccatcgcaaagaaagtaaaagccttgaaaaaagatggcacgaatgtctaactagaataaacagcatagagaagaccttaaatgacctgacagagctgaaaaccgtggcacgagaactacgtgacacatgcacaagcttcagtagctgattcgatcaactggaagaaagaatatcagtgattgaagatcaagtgaatgaaatgaagccagaagagaagtttagagaaaaaagagtaaaaaaaaatgaacaaagcctctaagaaatatgggactatgtgaaaagaccaaatctacgattgaatggtgtacctgaaagtgacagggagaatggaaccaatttggaaaacactcttcaggatattatccaggagaacttccccaacctagcaaggcaggccaacattcaaattcaggaaatacagagaatgccacgaagatactcctcgagaatagcaactccaagacacgtaattgtcagattcatcaaagttgaaatgaaggaaaaaatgttaagggcaggcagagagaaaggtcgggttacccacaagggaagcccatcagactaacagccgatctcttggcagaaactctgcaagccagaagagagtaggggccaatattcaacattcttaaagaaaataattttcaacccagaatctcatatccaaccaaactaagcttcataagtgaaggagaaataaaatcctttacagacaagcaaatgctgagagattttgtcaccaccaggcctgccttacaagagctcctgaaggaagcactaaacatggaaaggaacaactggtaccagccactgcaaaaacatgccaaattgtaaagaccatcaatgcaaggaagaaactgcatcaagtaatgagcaaaataaccagctaacatcataatgaaaggaccaaattcacacataacaatattaaccttaaatgtaaatgggctaaatgcccccaattaaaagacgcagactggcaaattggataaagagtcaagacccatctgtgtgctgtattcaggagacccatctcatgtgcagagacacacataggctcaaaataaagggatggaggaagatctaccaagcaaatggaaagcaaaaaaaggcaggggttgcattcctagtctctgataaaacagactttaaaccaacaaagatcaaaagagacaaagaaggccattacataatggtaaagggatcaattcaacaggaagagctaactatcctaaatatatatgcacccaatacaggagaatccagattcataaagcaagtccttagagacctacaaagagacttagactcccacacaataataatgggagactttaacaccccccactgtcaatgttagatccacaagagagaaagttaacaaggatatccaggaattgaactcagctctgcaccaagcagacctaatacagaactctccaccccaaatcaacagaacatacattcttctcagcaccacattgcacttattccaaaattgaccacatagttggaagtaaagctctcctcagcaaatgtaaaagaacagaaattataacaaactgtctctcagaccccagtgcaatcaaactagaactcaggattaagaaactcactcaaaaccgctcaactacatggaaactgaacaacctgctcttgaatgactactgggtacttaatgaaatgaaggcagaaataaagatgttctttgaaaccaatgagaacaaagacacaacataccagaatctctaggacacgtttaaagcagtgtgtagagggaaatgtatagcactaaatgcccacaagagacagcagaaaagatctaaaatcgacatcctaacatcacaattaaaagaactagagaagcaagagcaaacacattcaaaagctagcagaaggcaagatacaactaaaatcagagccaaactgaaggagatagagccacaaaaaacccttcaaaaaaatcagtgaatccaggagctggttttttgaaagatcaacaaaataggtagacccctagcaagactaacaaagaagaaaagagagaagaatcaaatagacacaataaaaaatgataaaggagatatcaccaccaatcccacagagatacaaactatcatcagacaatactgtaaacacctctacgcaaataagctagaaaatctagaagaattggataaattcctggacacatacaccctcccaagactaaaccaggaagaagttgaatctctgaatagaccaataacaggctctgaaattgatgcaataattaagagcctgccaacccaaaaaagtccaggatcagacggagtcacagctgaattctaccagaggtacaaagaggagctggtaccattccttctgaaactcttcaatgaatagaaaaagagggaatccaccctaactcattttatgaggccagcatcatcctgacaccaaagcctggcagagacacaacaaaaaaagagaattttagaccaatatccctgatgaacatcgatgtgaaaattctcaataaaatactggcaaaccgaatccagcagcacatcaaaaagcttatccaccatgatcaagtgggcttcatccctggcatgcaaggctggttcaacatacacaaattgataaacataatccatcgtataaacagaaccaaagacaaaaccatattattatctcaatagatggagaaaaggcctttgacaaacttcaacagcccttcatgctaaaaactcaataaattaggtattgatgggatgtatctcaaaataataagagctatttatgagaaacccacagccaatatcatactgaatgggcaaaaactggaagcattccctttgaaaactggcacaagacagggatgccctctctcaccactcctattcaacatagtgttggaaattctggccagggcaatcaggcaggagaaagaaataaaggatgttcacttaggaaaagaggaagtcaaattgtccctgtttgcagatgacgtgattgtatatttagaaaaccccattgtctcagcccaaaatctccttaagctgatacgcaacttcagcaaactctcaggatacaaaatcaatgtgcaaaaatcacaagcattcctatacaccaatgatagacagacagagagcagaatcatgagtgaactcccattcacaattgcttcaaagagaataaaatacctaggaatccagcttaaaagggatgtgaaggacctcttcaaggagaattacaaaccactgctcaacgaaataaaagaggacacaaacaaatggaggaacattccatgctcgtggataggaagaatcaatatcatgaaaatggccatactgcccaaggtaatttatagattcaatgccatccccatcaagctaccaatgactttcttcacagaattcgaaaaaactactttaaagttcatatggaaccaaaaaagagcctgcattgccaagacaatcctaagcaaaaagaacaaagctggaggcatcacactacctgacttcaaactatactacaaggctacagtaaacaaaacagcatggtactggtaccaaaacagagatatagaccaatggaacagaacagagccctcagaaataacaccacacatctataaccatctgatctttgacaaacctgacaaaaacaagcaatggggaagggattccctatttaataaatggtgatgggaaaactggctagccatatgtagaaagctgaaactggatctcttccttacaccttatacaaaaattaattcaagatggattaaagacttaaatgtcagacctaaaaccataaaaaccctagaagaaaacctaggcaatactattcaggacataggcatgggcaaggacttcatgtctaaaacaccaaaagcaatggcaacaaaagccaaaattgacagatgggatctaattaaactaaagagcttctgcacagcaaaagaaactaccatcagagtgaacaggcaacctacagaatgggagaaaatttttgcaatgcacccatctgacaaagggctaatatccagaatctacaaagaacttaaatttacaagaaaaaaagcagccccatcaaaaagtgggcgaaggatatgaacagacacatctcaaaagaagacatttatgaaaaaatgctcatcatcactggccatcagagaaatgcaaatcaaaaccacaatgagataccatctcacaccagttagaatggcaatcattaaaaagccaggaaacaacaggtgctggagaggatgtggagaaataggaacacttttacactgttggtgggagtgtaaactagttcaacctttgtggaagactgtgtgtgattcctcaaggatctagaactagaaataccatttgacccagccatcccattactgggtatatacccaaaggattgtaaatcatgccactataaagacacacgcacacatatgtttattgcggcactattcacaatagcgaagacttggaaccaacctgaatgtccatcaatgatagactggattaagaaaatgtggcacatatacaccatggaatactatgcagccataaaaaaggatgagttcatgtcctttgtagggacatggttgaagctggaaaccatcattctttgcaaactgtcacaaggacagaaaaccaaacaccgcatgttctcactcataggtgggaactgaacaatgagaacacttggacacagggtgggtaacaccacacactggggcctgtcatggggtggggctagaggggagggatagcattaggagaaatacctaatgtaaatgacgagttaatgggtgcagcacaccaacatggcacgtgtatacatatgtaacctgcacgttgtgcacatgtaccctagaacttaaagtataattaaaaaaaagaaaagtaaaaataaataaaactatccaaaaagaaaagaaaaaaagaaaatcagatagactggaggacagctcaataaaaagtgtgtagacataagtaggtgtgagatggcacagggccttggaattttgattttatttcaggtgcattggaaagccactggcaattttttttttttttttttttttttgagacagagtttcgctcttgttggccaggctggagtgcaatggtgcgatctcagctcactgcaatctccgcctcccaggttcaagtggttctcctgtctcagccttccaagtaactgggattacaggcatgcaccaccacaccaggctaattttgtatttttagtagagacggggtttgtctgatttctcttacggggtcaggctggtcttgaactcccaaccgcaggtgatccgcctgcctcggcctcccaaagtgctggcattacaggcgtgagccaccatgcccggctgccattgacagttttttaaaaagcagcaataggacatcatttttgatacagagaatgatttggagcagggaaaatggagatgaagggacctgttaggaggctagcgtagcaatctaggctggagtctatgccataccatctgaatacattcacaagatcttgaaagctaagcagagtcagccctggttaacacttggataggagtgatccaggttggaaacgtttatggcctgtagttaacatgctggatgtggaaatgaaagatagatggatcagttttgaaggtagaagcagcagcattttctaatggattggataattcccaggcttttggctcaagtaagtaagtggctagatggtgatatcatttataaaaatgaagaattcagagttttatttaggacatattcagtttgaaatgtctgtgagacaactaagtggaggtggcatagagtcagaaatgtgagtctggaatttaaagagatctggactagtcatacaaattttatgctcagtcacatcagcataaaaatgacattaaattgcatgggaatcagctcactcaggcagtggttgggagacgaaagaaaagcagtccgctaaggaagctgagaaagagaggccagcaaggtaggagaaaaccaggaaatagtgggaaatagcccagagaagttttcaagagaggaagtggtcaactctgttgaatgttgctgagatatgaagtgagaagcagagaagtgctttagattggcaacaggtgataatgatcttgacaggagtagttaaggaatagtggggacagatgctagattataatggcttgaagagtgaataggagagagacatttggctggagatttgaaattttttcccataatgtctcttgtagtacttaataaatcatttttttaaaaagatcaaaaattaaaactgaaaaattcaccagtggcttccagaccaggaaatgggcagaaacaacaaatgcagtaaacttcaaagccagaaaacaaaaaaacaaatgaacagaatattcaaaagtggagtggaggccgggtgtagctgttcacacctgtaatcccagcactttgggaggccgaggcagatggatcacttgaggtcaggagtttgagaccagcctggctaacatggcaaaaccccatctctactaaaaatacaaaaattagctgggtgtggttttgggcgcctgtaatctcagctatttgggaagctgagagaagagaatcacttgaacctggtagacggaggctgcagtgagccgaggtcatcccactccacttcagcctgggcgacagagcgagactccgtccaaaaaaaaaaaaaaaaaacctaaaagcaaagtggagaaacaagacatggctcaattcttttggttctggagaagacatgagaatgagattagagaaaaaaaggaaaaatcccttggtaggagtgacactttctccttcagaaaggagcaaagatatgtgcaggtgtgggtagttttgttgctgtggtggtgggaaaatagggagttcttattgatggggtcattttcttaattaaaggtgagataatcaggtgagagagaaaatagaagaaagtgtatgggaagtttgagaagaaagaggaaggtatcaaatagccaatttagagtgttgggaaatgagcctgtctgttcatttgaaattagttttagtctgttttgacctccaaaaatggcaatttcatatggtttgatccaacttgagaaacatggcaagtttttattagtttggaatctccctaactcaatatttattattctgaagtttatgttttggaatcattaaaaatattaataatgcaaaggaaagtcatctagataacttttgggtgaaatggttagactacttatggttccttcatgccttcagatattaattaggagactttaatgtgctaggctattagatctagtctaggtgagccaggtagatgtagtttctgcttttgtgacgctttagtggggaaaggcagacagctaagctatttgatcacattttactactccctgtgtgacaagggccaagcagaatttcagggtagcatgggagtatacctcagaatcatctaacctggtgacaggatagggcctgggcaggcttctcaaaatttttttttaaaacttaagacctgtaggatgcaaaatagcccagtaggaggtagaggaagacagttctagggaaagtgtgtgaataaaagcctataggtgagaagaggcatcacaaatctgaagaaatgggataactttaagaaagctgcagtagagtatgcttgaagatgaggcagaagagggaggttgagtccaaattatgaagaactttatcagcttttcgcaagccttttggatcttatcctaagagtaacaggaagctgttgaaggattttaagataatacagaattttgcaaacatgtttgcagcatccttttaaatgtaattactaatgtctgataaaatattgcatgtttttcaaaggtcacctagaaaagaactcatttatcagcacactaattggattaaatacttggaagtaaagtattatcttttaaaaatatcattgaaatgatgccttcttgcctcaatttcaagatcaggatagtctttttttccaaaaccatggtggctaattttaaaagtagaattgtatttacaatatttttagacttttttcactattgtttgagaaatattcttacctttttaaaaataggaaatataatgataaataaactattaaattttcattggcagaagaggtagaaagactggaaagagacctagaaaaaaagatgatagaaactgaagagcttaagagcaaacaaacaaggttccttgaggaaattaaaaatcaagataaattgaataaatcattaaaagaggaggccatgttacagaaacagagctgtgaggaactcaagagtgacttaaacacaaaaaatgaattggtaagttcatattttacattgctttggctgtattctcataagacagataattctttgcccttgggtctaaaaatacaacttcctgaccatataatggggaagatgtggtttaacagaaatatgtggaaaggcttatgaattgtagttgactgtgtgctagatgatatggcttcccaaaagactaatgctgtcttgagctgcattatgtactcctagatatttgtattttttaaaaacaacattgtaggtgaggctgttcattggcaaaaacatttagaaggcgatctggcaaaattatccaaaattttgtgagttataggtctttttggacatggaatccatcttttattactaagataaaatataatatctttatgctgattccctggtgcacgttactcagcccattgaaaaccttggcaaaatgtcagaccttaagactttccactatcccaaaactatgaactgtagttgcctagttttctcttttgcttatttataatgttattgatatgtttgtgctgtcaataaatgttttgtaaactgtcagaagtttttgctttttttttctatacctatttttgttagaagtcagactgtgctcttctctatgtcattatgttatttttatcattaaccatttaaaaacatgtttatgccaggcgccatcgctcatgcctttaatcccaacactttgggatgctgaggtgcaaggatcacttgaggtcagaaattcaacatcagcctgggcaacataatgagaccctgtctctacaaaaataaaaataaaataaaaacacatttatatacaaaattaatgtatgttcattgtaacaaatttagacaacacaactgtatttagcagaaatgaaagtccactcttccctaccccattccccagatattaatactttgttttccatgcttcttatacagtatacatgtaattacataatgtatatataattaagcatgttatacctttgaatatttttgtaatgaaaaaaggaatgttactgtatacagttattcctctgtatctgtgggggattggttccaggacacccccatggataccaaaatccatggatgctcaagtcctttatgtaaaatggtgtagtatttgcaagtgactttcgtacatcctctagtatactttaaaatcattgctagattacttataatacctaagacattgtcaatgctaataaatattatattgtttaggaaataataattaagaaaaaatatctgtacatgttcaatacagatgcaaccatccttttaaaaaaatatttttaatccgtggttggttgaatccacagatgcagaactcagatatggagagtagactgtatattattattcagcatcttaactttcacaaaacagcatacgtggacaactctccaagttaaaaaatatgtgtacatgcatgtataaagccttcttactctttttaaagtctatgttgtgttccattaaatgtattcttcataatttagttagcctattcctattgatggatatttaggttgctttcacaatttttgctattagagacagtactacagagaaaatctgtgtgtgtgtgtgtgtctatatataccttatgcattcatactagtatttctttagcataaaccactagaagtggaattaccgtgtaatttgcatttaaaattttgataagtgttaatgtacacttcaaaaagcttctaaccaatttatatttcagaagggaagaaaatacccaatttccaactaggtactattattttgaatttgtacatatggtagaaaaaaatggaatcttgttttaattttgaatttttatagttgttggacagttgagtattgcatatatatttattggctattttgtatttcctctttaaattgccagttcatattggttttgcctattatctgttagtcccaaggactattagatgcctaaaataattctgggtcttattctaagagcttatatttgaaaaacatttttattatcttttgcagaatatctaatgataatatcatctgtgattatgtgaagttttccattttaaaaaagtagttgcttgtgcattaggccaattaatgtataaaagaaaagtagcactgaagtaagtcttctggtggccatttaaaccgtagtagtcctgtcctgccaccaacaaatattaaccaaatttactctttgtccttttgcaaattatttaattcctgtgcttcagtttagttatatttaaaatgaggattatttacctgtcctgctagcctcacagaattgtgaggatttaatgagctaataatgaaaataatttgaaatgaatcaagctaagtaatggaaggtagtaaatctataactcagaatgacaataaaatacatccatgtaagaataatgccaatactaaaagccatgtcttcctatggtaagttgtcagtaaagagcaacttgtattattacagtttaactctccaagtgacggtatctgtttgcttcttcttttagcccttgtcttggtttcttgcaggcccttttctgctgattctttattcttccttaaaggtagttcttccaggcctgaactgtgtttttcagggtttgcatgataacttgcattaatatgcttgcttacattttaagttttgaaactggcttgtcttcttgggaaatgtggttgtgtgcgtatgtattatttttttttaatggatgtttatataggagagcaaatttgaatgtgggggaaagaattatttttctgattggtaaatatgttaccttcagtcaactcttgattatccaaagctaatactgtgactagcctactttccagttcatttgacatctattttgcttttattcatgcatttcttcaacagatatttattgagtgcttacaatatgctaagcctggggcttataaaagtcacaaaagtactttgaaatgcacagcctatttattattatttgcctgcagagaccagttcatgtattctctgtgattccagtcacatttgcctgttgtttgccactattgccaatgagttttgaggagagaacccaagattagttgacagtgttgattgtgagttgctttcttgagactcggagacttatgatcattcagtgaaaatatcaatgtgggtaatgtgctggacaccctgcagcagtacatcgaaggcagcatggaagaataggcagtattggatttgaaatcaggagacttggaattgaattctgcctcttccactaccagctgtgaaattgggcaagttatttaacttctctgtgcagcttttatcatcttattgggtggttgtgaagatttagtgcaataacatatgtaaaatgcttagcacaatgtctggcacacattgagtatttggctcaatgttacccattatctaggctattacttccattttgatggataatcaggaggtgactgtgagctaaatcatgcacgactttgatttcctgggccttgtaaaatgtttgtgtttgtttatgttttattctcttcagcttgcacttttatattaatgaaatttttctgcatgttttttctttgatatctaccatcagatactggccaaaaaaagacaaaaatcacttagtggatctttgaaataaactcaaagtttggtttagtagaaaggagctagtactagtagttagttaataaaatatttagtttctgacactgatctaatatgtaactttagacaagtcagttcatcaatctgagacttaatttctgtatttataaattcagagaattagattggatcatttgtcttctccaagctccaaaaatttctaagaataaaaagttatagtagaattactttattaaaattgaatattacatatttggatctggttgagcttattcacatcccttattctttattacaaagaataatattctgaacacttaatactacagcaacaacagtatgacaattaaaaccaagctcttcttttcatccttctcattcctctttatttctctgcagttaatgtcagttatcattttcccttgtaatttgaaactattgttaaagtcggaaagtcagtttaagaaattagtgctaattattggaaaatcaggaagcaggtatttattaggccagttacacaaaaataattgatacaaaaatattttcatgtttaacaaatttaagtgatttttaaaatcattattcattatatcgtgaagcagcagataaacttcaaaggtcttttacatgatctctgatgaaataataattttgtatttcattttttataatttagaagtaagataaaatgttctgagtgttgtgcagcttactgtgaagtttttaaacatatatgattataacttacgatgagaacttaccatatcatcacacctttatactaacttactgatcctgtatgttgtctcatatcaaattgggccaatagctaaaacagaagaccatagaattaacacgagcatgtcagaagcaatatgagctggaacaggaattggccttttataaaattgatgctaaatttgagccactaaattattatccatcagaggtgagttattttaattttttagtaatccaaagttaaagcccacatgggatggaatgggggagggcaggtggtgaggacatgtaagggatttgatcagatatcactccactttcttgttatgagaggattaaactgtattttggttcaatctatgacttatttggctccgggagttagaacagaatcctaaagaggtaaaaaacttcaaaagaatctttgcccatagccatatccattaccaaaagcagtcgtctaactcgcagctatctttcccaggtgtatgggttgatcagctcctttaaatccagacttctgggaaaagtgcttcagtaccatggaatagtcatccccttacatggtttgttcagtaattactgggttcagtattaatcaatcatgactggtacaaatgccataaatgtcactgcaagtgaggaaatgccaaacttctaagacccagtgattccaaccaatatcatatgatatttcatttttaaaaattcaattattaaaatatattatactgatggctacacaccatgtatctgaaaaaaatattagactgagattttatttatatgagccaagaaaccaaaataaaacacccatatttctaatttgagagatcaagcagtgctaaaaatcacataactgtaggcagttctttaatcaatcagtccaaactttcactcttctgtggtaagaggaagaattcttttgagaccatttttagttctaatttccttttttggtatattaagaagaagataaaagaataatatatatctttcagctcctaggcatgtagaatttatataaacttgagcaattctgtgatatgtttgccactaataaaatgaataatgtcatttgactgcttggagatcacttattaaaccataaatctattattttgcttttagtatgctgaaattgataaagccccagatgaaagcccttacattggcaaatccagatacaagagaaatatgtttgccacagagagttatattattgacagtgctcaggcagtacagatcaagaagatggagccagatgaacaacttagaaatgatcacatgaacttgagaggccacacaccactggacacgcaactggaagacaaagaaaaaaaaataagtgcaggttaaaaaaagttattttaaattctttaaaaaaaaatatgaaaacattgaatatgtaggccaattttgttttataagtcttttaattgaacatgttgatggtattgtttccatgaaaagtctaaaacaaaagtagtgattatcaagcagatttatcgagcatttattttgtaatgattcctgttatggttaagaatggagtttttggcagtaatttgatggcagcatgtccaggggattcaagaatgagtaaatcccctccttcaaataagcactggaactatatattcgaagtcacaattagtaataactgaagcaagtaaagaaccacttgattgattactatgcatgtagcaaaaacctaaagcaatgctttgtataagctgcaacagagcattctcctcaggcctgggccgaaggctagcctctgacttttcctgacatgccccatgccccacaatctaattcaagggatcttaataccttctggcaagtcacataaaggaataagtcaaggcagggggacactttagagaccctgccaatgacagactttgaatctatttacccactcagctgcatggatatggaagaaagagaactctgaccagggtttgtgcatccccccagcattatggcccactgtggtgctctcagtcagaccagcggcttatctttccttgactggtagctaagtggaaggcatggaaggcaaatagaggttgacttggtgaaggaagaaaagaaactgagttatttatgtctgcgtatactatatgcaaggctctgggggaaagcaaaaataaatcagatttttatgcagactagctttaaaggggctggctcatagttttataggacagagggagagagaaatcttaaatttgaggttgaaaataattgatttgagatcatcaacagctgggagagagagctcagtagtgaatttcttgatattgaattccatcataaagcatttgcctctaacacaaggttttatgggttatttttaatatcctgaacctaattataacttagtaacatgtaaagtgcatatttcccaataaaagtcttattctctcaaaagggtttactagtgttgggaatagcccctttcatgttgagaattttacaaataaaaggatcaattatagttctataccatataatgaaacagtttattctagagattaataaatagacaaaagcgatcataagtaattactttaaaatttttttgtgagatataatgacagtttaatagagcagggagaaggttattacaaagaaagaatacctggttgaaatttcagaattcaagatttttcttgtttcatattatgtgagcatggtttttaaatttgcagcacaaactcgactatcagaactgcatgatgaaatagaaaaggcagaacaacaaattttgagagctactgaagaatttaaacaactggaagaagctatacaactaaaaaaggtatgtaaaagcaaagcagcaatgctaagaggaaatgaaaaatgaaatgtgtttttcccttcataaccatataaaacaatttaaaaagcagttagctgcctagttaattatggaatgataaatttcagagtcaaatatggttctagaatttgccaattgtaattttcttccatttatgatgacatccaattagcattttataacatgtatagaaataaattacttaattttatgtaaaaaggtgtagtcttgagaagttgcttcctgatctatctcttctattttaattaagcactctccacctttaagatcctgggacttagattaagaaccaggagatatctctgctatagcatgaacattgtcatcaaacacaagccaaaaaaaaaaagagatatgtggtatacaaaaagattgatgtaacatattctcaaaaattaccaaagtgtgttgtaaagtaagcgagtaagcagctcaaatccatgatgtaattgcataggggcaaaaattcaagaaaaggaagttgcttgacattttagtttttaaatgggtaaaaaggttttagttatttgtaacttttaaaaatcagtatttaaaaattatgatggtaactacattcataccacagtaggtagaacaacaatgtgaagtccaaattgtagattcttttaaaagatacactgtattgttactttcagattttatactaactagaaattgactcaagtttattggaaccttactatatgtcagtcactgggctgggcgctgattaatgaacaaaatagacatgtgtccctctcatggacagacttgtgggggaaataaggcaataaacaaaaaggaaaaaaaatatttatttaaaaaaaaggaaagaagttaaaaagcatcagtgttgtaagaaaaaaatagaaaactaggggagatgttaaaagagatatactttagattgtggggattcacaaaggcctctctgaagaggtgacaggctaagatacaaaggatgagaaggagccagtgaggcagagctggcggaaagtattccatgcagaggtgacagtgtgcacaaaggccttcagactagagatttctctgcagaataagggagagtgtagaggaagataaagagtcttgaggttaaagatcatgccaggcttcataggcatttttttattttttatttttatttttttgagacagggccttgactcctgggctcaggtgattctcccaccttagcttccagaatagctgggactacaggcatgtgccatcactcccggctaattttttatatttttttgtagagatggagtctcaccatattgaccaggctggtcttgaactcttaggctcaagcgatctgcccgtcttggcctcctaaattgttcataagccatcttaagaagtttgaattttattttgcatgcaatgggaaatctttgaagggctttagatagttgagtggctgatcctatttgtcactttgccttacttcatgaagagtgaaatggactgagtgagatggaagggatgtgtgcatctgtatctgtcaggaggctgttgttcagtacaggcaagagatgatactagcaccaaccaggaaggtgctggtggatgtggagagaaagccagctgattccaggaaacactggacagtagaactgacaggacttaatgatgggttgaaagtaggagatgaggtagagggagctatcaagacggttttactaatttaaaaagaattttttataatagtactggccaaagctttacatagattgatagatgtaaataatgtacttaattttaaaagaaatagatacttccaaaatatgcttggaaaatagttatttaaatgagttaacattaacagttaataattaataataaagttaatagcctaaatttttgtttatactgttcacttacttgacatgctaacaaaggtaagcttcagctgggttctgattcagtgaaataaaaatctcaatttaataagagtttgctgtattttgaaattatttagtatgagatgattgtccagtgaacacggaattctaaaattttttcctgattataaaggtattgcagttatggggaattacataataatcgtccatattttatttcttttcagtcttttatcttcatcttttttacacttctatacagactcttgagaaatttttatatttgtttaaatctctatgctaaaaactgttagaaataagagatagagtattaagttattacttctatgtcaatactcaatttattggttgactatcttcatattaaaactaattaggtaactgtagcgtagtagtcagtgaaattgtctagagtcacacaaagtcttgcttccacaaactcctagtatgaccttgggcgagatatttaaattttccatgattcagtttctttatctataaaattgggataattatactttttactttatatgttttgaggattagattaaaggatataaagaggctgggcatggtggctcatgcctgtaatcccagcactttgggaggccgagacgggtggatcatgaggtcaggagattgagaccatcctggctaacatggtgaaaccccatctctactaaaaatacaaaaaattagctgggcgtggtagtgggcgcctatagtcccagctactcgggaggctgaggcaggagaatggcgtgaacccgggatgcagagcttgcggtgagccgagatcgcgccactgcactccaccctgggcgacagagcaagactccgtctcaaaaaaaaaaaaaagtatataaagagtttagaacagtgcatggcccatagtaagtgctatataaagttggctattattaatactatgtttattattaataatttacaagttgcctatactattatagaatgacagcttatttgtgcttgctattattagttttcataaacttttataaagtatgattttctacatataagcataaaaatataaaatatgcatggagtgcttagataactcccacatttcacttttatttttaaaaaactgatagaatatagaatacttattaaaattatagacattgtcttaataaatcagtgttgttcttctctgttaattatatattggggtttggggagattagatttcagaagcagggaaagaccttctttacaagcagttgagtggtagactacaacttgtaaataaattacgccaggaagctctggatctagaactgcagatggaaaagcaaaagcaggaaattgccggaaagcagaaggagattaaggacctgcaaatagccatagatagcctggattccaaagacccaaaacatgtgagtaaattaagaaattttgacttgttctgtctacatattacatgtctcatcattgttagcatcagagtccagagtcctttctgaaagtctgttttagtttgatgtacaaatttaagtgatatatacatacagtcagccctccatatccatgggttctgcatctgtggatttaaccaactgcagatcacatatattaggaaaaaaaaggatggttgtgtctgtactgaacatgtacagactttttttcatttgtcattattccctaaacaagacagtataacaactattcacatagcatttatactgtattaggtattataagtaatctagagatgattttaatatataagaggatgtccataggttaaatacaaatattatgctattttatagaagggacttgagcatcagtggatcttggtatctgcagggaatcctgggatgaatcccccatggatactgaaggaaaactgtacatatatgtgtgtatatataatgtatgtatgtgtatatatatgtgtattatacataaatatatgtgtgtgtgtgtgtgtgtgtgtgtgtatacacacacatatatggaatgtgtatgtctaaaacaaaacaacctagggcttgaagaaggtagctttcagtaaatgatggccgcatggtatatttatttttttttaagtggttgaatttcattgtattgcagagcaagggagatttgctccttacctttctctctccttgcctttttttcatctttctttctctctctctctctcttttttttttttttgctctgtcgccaggctggagtgcagtggcgcaatctccgctcactgcaacctccgcctcccaggttcaagcgattctcctgcctcagcctcccgagtagctgggactacaggcacccaccaccacgcctggctgatttttgtatttttagtagagacaaggtctcaccatgttggcgaggatggtcttgatctcctgaccttgtgatccacccacctcaacctcccaaagtgctgggattacaggcgtgagccaccatgccctgccgaagcgattctcctgcctcagcctcctgagtagctgggattacaggcgcgcaccaccacacccagctaatttttgtatttttggtagagatggggtttctccatgttgctcaggctggtctcaaactcctgacctcctgatctgcctaccttggcctcccaaagtgctgggattacagtcatgagccaccatgcccagcccttcatctttcttaagagcagaaaaagctgaagggggttgcgagtcctttttctacctcttctatttaatcctttttgcaaattttccactgaacgtatttgttttttcatactgttttgttttgtccttaaaaaaggaaacattctctggaatgtttcttcctgagatatggctagatatggtcaggtggctggatacagccaggctcttgtctctgtctctactctaagaagttgtactaattgcttatattttagctaatattcctaaaatacaaggaaaaatatcttctacatattctcctggtataccttgaataataggggttttttttttaaagaactttaagatctctggattaatagaaatcatagaatttaacatagtaaggatattgtaattgctttaagtacttgacaagttgtttaactgttcctttaagcattttagtacatatcatatatatttttttgtgggccagctaatttcaataaaggataaccttatgacagatataaggtcttttctaacaaaagcctaaaaattgaaaccaaggtattaatattgaaaccaaaagtagtcttgattattttaaataattttgaggaaaaatggggtattttaagtaatgtataatgtggtcaataatatcttactttattgcatatgtttgttcaatctcccacccatgtaaggtccctgaagacatgaactctatcctactggtatccgtatccccagggaccaaccagccctatgtttatgaatgcttgcattgtggaagggaggaaggaagcagcttatagatcctacccaaaactcctttgcttccccttccagttctgtgatctatgagtctaattagtagctggattatgtgtttgctttcaacaaatgactgttatatttctggcggacagagagttcaattcccactggatttctgtagagaattatacatggaaaggaggtaaatgagacatgggaatggcatccaagttttgaagttagctaaaatcaacctgtgcagtggggatgaaacatacaaaccagatttgaatttcctttttaattttattaaaattactaatagttcttaagtttgcagccttagtcctagcatcagaggacatctcttttaagtttatccagcgggaacatctttttctgattcacaaagtttcatattggctagtgtttggcatcccattttaggctacaaaatgtgagcctttaagcagaagagaaataatcaagagtgagatgcctgcatatttttctatagatataggtagacttttatttaattaatttttatgtaatcagatgaagtatctttctgaatagccaatagaatttaaaagtaaaagcttcactttgatgagatattatagaaagcaacatattaagtgcccacaatgtgtcatacattgtgctgtattttccatgttctggtgaggaacttttattaacatctatccatttttctttcaatttgcagaggatgaaaatgtgatatagaaatattaagtgaattgcccctaagttattgttttagaaagaggtggagcccttgcttatgctaccacaatgaccctctcttcacaaagcaattaaaggtctaaagagattattttaaaattagctcagaactaagcctaggcaggttttcagcaaatataagcatttaactaggtttcaaattcacagactattttagttataaaattattcatagaagcacaaattatcaccggagcaaacataatgaagatttgtattgcttttctctattgggaaatgtcctattggaagcaaaaggtaactgttcgctagagggaacgagctgtagtgatctgttgcaaagtttgggcgtgattggcccctgggagcttcctgtgttatgatttaactcgcggagggtggggcctgcccgcagaggctgctggtgattggatgggcggggccgccgctcactcttggccaagaatgtggtttgaggctctgcgaagttacagaggctcggaggcgcttgcaaaaatgtggctgtcagagagggaagtgcacatgaatttgaagacagcattagaaagcgttccgcccacagtttctctgttctcaacggctcagttttaacaggataaattttaagttaaggtatgatattttttctctctctgtacaaaggacttaaaaggaggaggagtcagagatgtaagttcctgtttttacaataactcttttgtgagctccaccgtggtgtaaatcgcagaatctacttttgttcccatgtatttaatgtacaccattggcatattgaaccagatttttatcctgcgtataaaggttttggtggaatttttaatggtgaattttaaagatttattgatatgagtgcagtcttttaagaaattatttcttgagccataaaaacccgaaatttacttagaatgtaagctgttatatgtagttaacttttcagaaagatttcaaatgggtattttgggagtgtagggaaaagagtttgcaaaataccataaagctttaccagtagtaaattaaaaaccttccagttaagctgccactcttttgttcatcagaaatgaagagacgtttctttcttgtatttggggtaagcaaatacataaaattgagtaatattcttttataatcacatgggtcttagacttgagatcattggtgttcatttttctgactgatacagttccctctttcgataactttctcttcatttattgttgtattcctctgatcctgtgggtaccaacttaagagtcatgaaggtgtgagtgggagggcaaaggttctctggggaattattttgtctccatatgaacagttgcctcaggagacatgcaagtcatttgatggatctgaaattcagttttctcatgtttaaaaggaagggttagactagatcattggctctcgatttgctttccctagcacacctgagaaatacaatccattcttttcagttaacagtagttccctgatgccatgacttcagggtgcgggagggtgtgtgggtgtgtgaaagctctgttttccaccatgggttaagtgtagttgtagaggggtatacctccttagggccctccattttgagactcaccgggctaagtggtctttgaggtccctgtcagctctcagtttattgaaaagccaaatgtttgtttgtgtaagagattgaaagtgaatttgaatttcaagtattttatctatttcatacctctattttcttctaagaaaccttttttaaaaagtagatttaatttttttattaaaaaggcattacttatctactataaaagttttttaaatataaaaatactcattacaaaaggaaaaaatccccatgtaatccttccacccaggtataattcttgttagcattttgggatatagtttttaagtctttttctatagatatatgccataaccaactaattttggaaaccttttttaaaagacacattttaggctgggcacggtggctcatgcctgtaatcccagcgatttgggaggccaaggccggcagatcacttgaggtcaggagttccagatcagcctggccaacatggtgaaactcccgtctgtactaaaaaaaacaacaaaaagtaaaaacaaacaacaacctgggtgtggtggcccgcacctgtagtcccaggtacttgggaggctgaggcaggagaattgcttgaacccaggaggcggaggttgcagtgagctgagatcgtgcctctgcactctagcctgggtgatggagtcagactccatctcaaaataaataaataaataaataaaaaagagagagagagacaatttaatgcaacgcaaataacactgacctacctagctgtgcccttggaaaaaccacttaacctctttgatcctcagttttctcacctgtaaagtggaaatgatttccgtatcaagttatcctgaaatttaaatgaaaactacccatgtgaaaacaatatagggcctgacacaaatagatgcaaattattatatttattttctattcttcctttaaaaatgttgttaagggttattacttttaaaggagtttaaggaacttggagttttgttgatttttttttttaattcagtcccatatgaaggctcaaaagagcggtaaagaacaacagcttgacattatgaacaagcagtaccaacaacttgaaagtcgtttggatgagatactttctagaattgctaaggaaacggaagagattaaggaccttgaagaacagcttactgaaggtaagactttcagtatgatttaaggtaaatcagtgttattgctggtaaaagaaacattataaagacaagcattaatccagatagtagctaaatacagttcacctattagtactagtatttgatagggaaatatttacaggatacccaaaagtagttaatgcaattttaagagttttgtttttgttttgttttgtggcattgatgcctagtgagtcaggtcattccagtcagtaggccagaagtcaatacgtgatcatgataagctctggcatgtgattgtctatgacataaaatccattcaggagcaaagcacccattggcatcagggaattcagtgtctggttataagaagaaagagttttaggatctagttttgcaatgctgatttaaactgcgacatatccataatagtggaaaaggaagacaataggccatagtggtttttacacatagggctcagtgtaaaaagatcctgctctctgttttgctactgtcagctgtgtcgccttggacaagttgtttttatctcaatcattagttgttgggagaattaaatgagctagtattcataggccaggagtggtggctcacgcctgtaatcctagcactttgggaggctgaggcgggcatatcatttgagcccaggagttcgagatcagcatgggcaacatggcgaaaccccgtctctacaaaaaaaaaaaaaaaaaattagccaggcgtagtggtatgtgtgcttgtggcaccatctgcttgggagactgagggtggaggatcacctgagctcagggaggttgaggctacagtgaaccgtgattgtgccactgcactccagcctaggtgacagagtgaaactttgtctgaaaaaaaaaaaaaaagagagagatagtgttcataaagttcctggcacatagtgcgtatccagtactgtacatgggatgtgtgtgtttgtgttctaagtgtttaggttacacatttatgttgccagtcttggattcatcttatatactaggtggtcttgttctttgtatttagcagcaagaactcacagttttggtacatattttttattttatttgtaaattaaactttttttttttttttgagacggagcctcgctctgtcacccaggctggagtgcagtggcgtgatcttggctcactgcaacctctgcctcctgggttcaagtgatcctcctgcctcagcctcgtgagtagcagggactacaggcacatgcccggctaattttttgtatttttaatagagacggggtttcactgtgttagccaggatggtctcgatctcctgacctcatgatccgcctgccttggcctcccaaagtgctgggattacaggcttgaaccaccacacccggccgaaattaaactttttacagcatgaatcaggcattttataagcattgccccctaaatgtactatttttattttatacctgcttaatactcctttgctatctataataggaagaaaatttaacattatgttttgaaaaagaaaaatgataggaaagaattgaaagcttagaatttcactcttggcttataacaaaatgctgagcagacaatgcagtactttaaaaagatatattattaccctttttgcatcttgcttaggccagatagcagcaaatgaagccctgaagaaggatttagaaggtgttatcagtgggttgcaagaatacctggggaccattaaaggccaggcaactcaggcccagaatgagtgcaggaagctgcgggatgagaaagagacattgttgcagagattgacagaagtcgagcaggagagagaccagctggaaatagttgccatggatgcagaaaatatgaggaaggtatgatttttttcctgcctattttccgtagcttcataagtagataatgtccaaattaagttagttggaggaggtaacagtacatttttaagtgggaaaaagtattagtggctatatggtgatttttttcttttaacagttgggcttttttttttcttctttagctgtgatacatttggaattattattttttctttgctcagaaaaggaagattatttaagctgcatttctatccctgaaaggtattgttgccaaataactctaaagaatatgaaatggtagctattacaaatattgtattaaatgctcatattttatttgtgctgaaaaattgagcacagaatggtttttcttagtcttgttgttactggataattttaacattattttatagctaacaaaacagacatattgttttaaattatatccttatgaacctgatttgttgcacattcgtttggagatttcccttgctctattttagttgtttggaaaatgttatcatacatgagaactagagatttccaaacttcttgttcagtagagctggctccagaaattgaattaatatattttaatattatgaaatatctcaggcatatttaaaaaatcacaaataatatttaacatcatgtactgacaacccagcttaagaaataaaacattataggtacatttgaaatcctctgtctactcctttccagaagtaacaaagttctgaatatggttattatttccctgcacctctattcttttattatatatgtaaacatccataagcaatatatagtattttccttgattttaagacttatacaaaatgtatcatagtgtacatatttggccactttctttcttccttcatgtttatgtttttgtttgtttgttttggtttttttttgagatgaattttcgctcttgttgcccaggctggagtgcagtggcgcaatctcggctcactgcatcctccgcctcctgggttgaagcgattctcctgcctcagcctcccgagtagctgggagtacaggcattcaccacctgcccggctaattttgtatttttagtagagatggggtttctccatgttggtcaggctggtctcgaactcccgacctcaggtgatccgcctgccttggcctctgaaagtgctcggattacaggtgtgagccacagcgcctggcctatgttttcgagaattatgcacactgatagatgtagttctactttgttcatttttactgatatatgtaccatcctgctttatggacataccacaaatttattatttattccttctctttttggggtgcatttaggtgatttccagtgttatgctattgcaaacaatgctgagcataacattcctgcacacatcttgaacacatggggactatgctcagaagcagaactgtgggtcagagtatgtccatccttcattaagttcagtagatattgtcaaattacttttcatagtgagtttatcagcttctactcccaccagcaatgtgggggctaccattcttgccacatccttgccaacgctgtagtgttgtccaacttttttttaaagcttatattttgaaataactccaaacttgcaggaaagttgcaagaggaatacaaataactcacatttgcctttcaccgagagtcaccaattactattttaacacatttgctttatctcctcatatgtaatttctacatgattttatatactttttaattattattatactttaagttctagggtacatgcagatttgttacataggtatacatgtttcacgttggtttgctgcacccattaactcgtcatttacattaggtatatctcctaatgctatccctcccccctccccccaccccacgacaggccccggtgtgtgatgttccctgccctgtgtccaagtgttctcattattcagttcctacctatgagtgagaacatgcggtgtttggttttctgtccttgtgatagtttgcaaagaatgatggtttccagctgcatccatgtccctgcaaaggacatgaactcatccttttttatggctgcatagtattccatggtttatatgtgctgcattttcttaatccagtctatcgttgatggacatttgggttggttccaagtttttgctattatgaatagtgccgcaataaacacatgtgtgcatgtgtctttatagtagcatgatttataatcctttgggtatatacccagtaatgggatcgctgggtcaaatggtatttctagttctagatccttgaggaatcgccacattgtcttccacaaaggttgaactagtttacactcccaccaacagtgtaaaagcattcctgtttctccacatcctctccagcatctgttgtttcctgactttttaatgatcaccattctaactggtgtgaaatggtatctcattgtggttttgatttgcatttctctgatggccagtgatgatgagcattttttcatgtgtctgttggctgcataaatgtcttcttttgagaaatgtctattcgtatcctttgccccctttttgatggggttgtttttttcttgtaaatttgtttaagttctttgtagattctggatattagccctttgtcagatgagcagattgcaaaaattttctcccattctgtaggttgcctgttcactctgatggtagtttcttttgctgtgcagaagctctttggtttaattagatcccatttgtctattttggcttttgttgccattgcttttggtgttttagtcatgaagtccttgcccatgcctatgtcctgaatagtattgcctaggttttcttctaggatttttatggttttaggtctaacatgtaagtctttaatctatcttgaattaatttttgtataaggtgtaaggaagagatccagtttcagctttctacatatggctagccagttttcccagcaccatttattagtgatcctttccccatttcttgtttttgtcaggtttgtcaaagatcagatggttgtagatgtgtggtgttatttatttctgcagtctctgttctgttccattggtctatatatctgttttggtaccagtaccatgttgttttgtttactgtagccttgtagtatagtttaaagtcaggtagcgtgatgcctccagctttgttctttttgcttaggattgtcttggcaatgcaggctcttttttggttccatatgaactttaaagtagttttttcgaactctgtgaagaaagtcattggtagcttgatgggaatggcattgaatctataaattaccttgggcagtatggccattttcacggtattgattcttcctacccatgagcatggaatgttcttccatttgtttgtgtcctcttttattttgttgagctgtggtttgtagttcttgaagacgtccttcacatcccttgtaagttggattcctaggtattttactctctttgtagcaattgtgaatgggagttcactcacgatttggctctctgtctattattggtgtataggaatgcatgtgatttttgcacattgatttttgtatcctgagactttgctgaagttgcatatcagcttaaggagattttggctgagacgatggggttttctaaatatacaatcatgtcatctgcaaactgagacaatttgacttcctcttttcctaattgaataccctttatttctttctcttttctgattgccctggccggaacttccaacactatgttgaataggagtggtgagagagggcatccctgtcttgtgccagttttcaaagggaatgcttccagtttttgcccattcagtatgatattggctgtgggtttgtcataaatagctcttattattttgagatacgtgccatcaatacctagtttattgacagtttttagcatgaagggcaattgaagtttgttgaaggccttttctgcatctattgagatatcatgtggtttttgtcattagttctgtttatgtgatggattatgtttattgatttgtgtatgttgaaccagccttgcatcccagggatgaagccgacttgatcgtggtggataagctttttgatgtgctgctggattcggtttgccagtattttattgaggattttcacatcgatattcatcagggatattggtctaaaattctctttttttgttgtgtctctgccaggctttggtatcaggatgatgctggcctcataaaatgagttaggattccctctttttctattcattggaagagtttcagaaggaatggtaccagctcctctttgtacctctggtagaattcagctgtgaatccatctggtcctggagtttttttggttggtaggctattaattattgcctcaatttcagatcctgttattggtctattcagagattcaacttcttcctggtttagtcttgggagggtgtatgtgtccaggaatttatccatttcttctagattttctagtttatttgcataaaggtgtttatagtattctctgatggtagtttgtatctctgtgggattggtggtgataccctctttatcattttttattgcatctatttgattctaccctcttttcttctttgttagtcttgctagcggtctatctattttgttgatcttttcaaaaaaccagctcctggattcactgattcttttgaagggttttttgtgtctctatcccctttagtttggctctgatcttagttgtttcttgccttctgctagcttttgaatgtgtttgctcttgcttctctagttcttttagttgtgttgttagggtattgattttagatctttcctgctttctcttgtgggcatttagtgctatacatttccctttacacactgctttaaatgtgtcctagagattctggtatgttgtgtctttgttctcattggtttcaaagaacatctttatttctgccttcatttcattgtgtatccagtagtcattaggagcaggtcgtttagtttccatgtggttgagtggttttgagtgagtttcttaatcctgagttctaatttgattgcactgtggtctgagagacagtttgttgtgatttctgttcttttacattttttgaggagtgctttacttccaactatgtggtcaattttggaataagtgagatgtggtgctgagaagaatgtatattctgttgatttggggtggagaattctgtagatatctattaggtctgcttggtgcagagctgagttcaattcctggatatccttgttaaccttctgtcttgttgatctgtctaatattgacagtggggtgttaaagtctcccattattattgtgtaggagtctaagtctctttgtaggtctctaaggacttgctttatgaatctgggttctcctgtattgggtgcatatatgtttaggatagtcagcccttcttgttgaattgatcccttcaccattatgtaatacccttctttgtcgcttttgatctttgttggtttaaagtctgttttatcagagactaggattgcaggccctgcttttttttgctttccatttgcttggtagatcttcctccattcctttattttgaacctatgtgtgtctctgcacatgagatgggtctcctgaatatagcacactgatgggtcttgactctttatccaatttgccagtctgtgtcttttaattgggggcatttagcccatttacatttaaggttaatattgttatgtgtggatttgatcctgttgttatgatgctagctggttattttgtccgttagttgatgcagtttcttcctggcattgatggtctttacaatttggcatgtttttgcagtggctggtacgggttgttcctttccatgtttagtgcttccttcaggagctcttgtaaggcaggcctggtggtgacaaaatctctcagcatttgcttgtctgtaaaggattttatttctccttcactcatgaagcttagtttggttgaatatgagattctgggttgaaaattattttcttttaagaatgttgaatattggcctctactctcttctggcttgtagagtttctgagagatctgctgttagtctgatgggcttccctttgtgggtaacccagcctttctctctggctgcccttacattttttccttcatgtcaaccttagggaatctgacaattatgtgtcttggagttgctcttctcgaggagtatctttgtggtgttctctgtatttcctgaatttgaatgttggcctgccttgctaggttagggaagttctcctggataatatcctgaagagtgttttccaacttagttccattctccctgtcacttttcaggtacaccattcaaacgtagatttggtcttttcacatagtcccatatttcttggaggctttgttcatttctttttactcttttttctctaaacttctcttcttgctttatttcgttaatttgatcttcagtcactgataccctttcttccacttgatcaaattggctactgaagcttgtgcatgtgttacgtagttctcatgccatggttttcagctccatcaggtcatttaaggtcttctctacactctttattctaattagccattcgtctaatcttttttcaaggtttttagcttcctttcaatgggttcaaacatcgtcctttagcttgaagaagtttgttattactgaccttctgaagcctacttctgtcagctcatcagagtcattctccatccagctttgttctgttgctggtgagaagctgccatcctttggaggagaagaggcgctcggtttttagaattttcagcttttctgctgtggtttctccccatctttgtggttttatctacctttggcctttggtctttggtctacctccagatggggttttggtgtggatgtcctttttgttgatgttaaggctattcctttctgtttgttagttttccttctaacagtcaggtccctcagctgctggtctgttggagtttgctagaggtccactccagaccctgtttgcctcggtatcacaagtagaggctgcagaacagcaaatattgctgcctaatccttcctctggaagcttcttcccagaggggcacccgcctgtatgatgtgtcagttggcccctactgggaggtgtctcccagttaggctacacgggggtcagggacccacttgaggaggcagtctgtccgttctctgagctcaaacactgtgctgggagaaccactgctctcttcagagctgtcctacagggacgtttgagtctgcagaagtttctgctgccttttgttcagctatgccctgctcctaaaggtggagtctacatgtagaggcagaggtcttgctgagctgcggtgggctccgcccagttcgagcttcctggctgctgtgtttacctactcaagcctcagcaatggtgaacgcccctccccctgccaggctgctgcctccaaggtctatctcagactgctacactagcagtgagcaaggctctgtgagcatgggacctgctgagccaggtgtgggatatgatctcctggtgtgctgtttgctaagaccattggaaaagcacagtatttgggtgagagtgtcctgtttttccaggtactgtcttctgtgaatgtacggcttcccttggctaggaaagggaaatcccccgacgccttgcatttcctgggtgaggcgatgccctgccctgcttcgggtcgccctccatgggctgcacccactgtccaatcagtgccaatgagataaaccaggtacctcagttggaaatgcagaaatcacccgtcgtctgcgtcgatcacgctgggagctgcagaccaagctgttcctatttggccatctcggaacgggattcaattttatatatatttttatacagattttttttcctgaaccatttggaaatcagttgtagacatcatgctcctttgcttctaaatatttcagtatgtatttcctatgaacaaggacattttctaacataaacacagaataattatcaaatttaggaaattcagtattttatcagacttcatgtttgccagtctgctgagctttaaaggacttctttccatctttctattgtgaagatgtttacagttacaagaaagttgaacaaatagtttggtgaacatctgtgaacctcttggattcaataaatattttgatttatttattttctctttctcatagacacatacttttttcctttgctcattagaaagttgtagatatcataacatcatcccttcaacacacatttttttaagagcattttcctgcatcactacgatatcattattacacctaagaaaaatgacggtaattccctaatgtcctctaatatcattattatttttttttttttttgagatggagtcttgctctgtcaccaggctgggaatgcagtggcatgatcttcgctcactgcaacctccgcctcccaggttcaagtgattccgctgcctcagcctcctaagtagctgggactacaggcgtgtgccaccacgcctggctaatttttttgtgtgtgtgttttggtagagataggtttcaccatgttggccaggatggtctcaatctcctgacttcgtgatccacccgccttggcctcccaaagtgctgggattacaggcatgagccactgtacccggccctaaggtcctctaatatctgaaccatattcagattttcttgattgtcccaagaatgtgtgtgtgtgtgcacatgcgtgtgtgaaatccaggctggtattctgtagattgaaccacgttctgggtttgactgattgtttcctcatggtgtgtttaacttgtatctctatgttctatgtaaaatagtatcttaagttaactgcattttcccctggttactggagaggctgatcacctttcatttgctgttcaagtttcctcttgagtgaattccctattctattttttgttgaactgtctctgccttttcttaaagatttgtaggaattctttacatattctggataataatctttggttggttatatgtagtatctatattttaaacaagcagcccaaatgattgaattgccaagtggtttttggacaattcttttgtagaagttctcatcgtagaatcctcctctttaatctgtaatagtttgatcccaagtaaatagatgaaagagataaggtttaatcacaaaacacaaatggactaaaatgaatcagaaccatggtatgctaataaatatgtacttatattcttgttagcactcatttaaggtactcttatcatccttaatattagagagtgccggtcccattttgttcttctgataaatgaacatgctatggtttaatagagagagtatgggctttggagtcggagatctacatttgtatgctgactatcctttttctagctacatagccctgtgcaatttacttagatattcattctacaattcctcatctgtaaaaccgcaagttgccttatacagttattgtgaagatacaatgaaataatgaatatgaaaacattttgtccaacatcagatgaaaaataagcattaaatcttatcctactctttttttccttcctttcttcctccttatgtttttagactcataagtatcacagaactggtccctttgaaaaacaatatgttgggagcttactgactttcttgattacatttagccagggttttgttttccaaccaggatatgcacaacctgaggcttcgtcatattgctactgaaaactttgtggcaggcatcagtagctggccagcatttggtttacagtgctcaagttacttataatgccttgcaaatgcttaagcagcacagtgagggttccatagttaaacccactgaatctttctaggagcttgcagagctagaaagtgccctccaagagcagcatgaggtgaatgcatctttgcagcagacccagggagatctcagtgcctatgaagctgagctagaggctcggctaaacctaagggatgctgaagccaaccagctcaaggaagagttggaaaaagtaacaagacttacccaggtaagtaggagcatgaagccaactgcaaactaaggaccctgtgccttaagatatcatccttcttttatttatgtcttaatttaaaattaagcgttttttcatacaatatatatggagtgatgggaaaggcagaattttggagtcagacattgtgagtgctaataactacccctgtgtgaacacgggcaaatcagttcatagctctgagcctcccagccttttcctcctgtgtaaaatggcttatggggaagataaatgagataatggacatgaaagcacctgacagttgatactcaataaatgctagtttttccttcttagaacaggtttaaggacttttttttttgagacagagtcttgctctgttgctaggctggagtacagtggcatgatgacggctcactgcaacctccgcctcctgggttcaagtgattttcctgcctcagcctcctgagtagctgggactacaggtgcgcgccaccatgcctggccaattttttgtatgttagtagagatggggtttcaccatgttggtcaggctggtctacaaactcccgacctcaggcgatccacccacctcagcctcccaaagtgctgggattacaggcatgggccaccgtgcctggccgagacctcttttaggttgatgataagttgtagtttgctgtctccttttagggttggttgaaagatccactagtttaaattatacttgcaagttacagaaaacatatccaataaatatttattgattggccattgagggccaggtactgtggattctctagggaaagcacagacatggtcaccatcctgtggagctgacagatctctgattggtaaactttagtccagcaagtgaaacaggtatggaagaaagaaagggacaggattctttggccaaggaggaagtagtcagggaagaccaccctacagaaatgatgtttcagctgatggctgatggatgagtaggatttggccacgcagaggggacagggtgaaaggagtaaaggtaaggtatttgtattctaggcagagaggtgaggagagagagcatatagtacatttgaagtgctgaacgtatgcctccaggatgccaggagcagggagaggagtgaggaaagagaatgagaggtaaaggcagagaggcaggcagaggccagttgtaatatattctttatcagattaaaaatacaatttattagccagatgagctgcatcttctttcaggaagcccacctcaacctttcctttctgcctgctgaaaatctgggttcaggactctactttggttttcctataacctgtgcacagtaaaggtatttatcatgcatatgatgatcatctgtttagatgctcctagatgatctgtttgttttaccccagctagactcagagctcagtgaatgcccaaattgtatctgtttgtttctgctttttctgtgcctggcatatgagaagcgtcaatatgtgcctatttgatgaaaatgaaataaataagatattttgaatctcaggaatgcatgtaaaaataattcatatggttagaaaaggaactagaaatatatctggtttattatagtaattatgtatatttctttacttatgagatatcagatcatcacttgacagttgtcaggattgtatttctcgagtaccgagttttgtagaagtatagttgacaagatcagagtctcagaaatcaggaggttttaggaaaacaattaaaataacagtaaatattttaaaataataataaataaaatttctagatggcattttccttaataaattctcctcttttcaagccagactgtactagcttgaaatacactgtcctttgtactttgattggcttttattttcttctcataagtcttgacaaaattattttaagagcctggccttttcaccaattcacttggtattgaaagggacattccccctccctcagcaccaagactgccaggattggtcttcaaaccacacattgagaatatgaagcataacagatctcctgtctctgatctgaagatctacagatctctgattggtaaactttagttgcatgaactcacttgtgatgcttgataaatacagattccttggccccacccactctagagattctgatccagaatctcttttctgagatagagtttaggtgtctgcatttttaacagacatacctagtgttgatacagtttttttgaggaccacagtttgagaaatactagtctaagggaaaggagagcaataattgttggatcacttgcagaacttttaaaggtaggtgcctcggcccacccctgaagattctgatttggtgtatttgggctgagctgattctgatgcttactccttcttaagtgttaataatagtttaaggattgtgtgaaaaaattatctttggtttttaaatttgggagtacaaacataaaattgagttgtaaaactatagctagcaagggattgtgtgtatatgtaaatttatttgtgccttttaaaatcataaattattgctgttttacactttcatgtcattgcttcctatggtgacagttagaacaatcagcccttcaagcagaacttgagaaggaaaggcaagccctcaagaatgcccttggaaaagcccagttctcagaagaaaaggagcaagagaacagtgagctccatgcaaaacttaaacacttgcaggtagagatttgttgttttagaatacattcttacacagaacacccaaagatgatgatatctttagtcaggcacttagcaacctgctctaacatgtagtaagcaatttgaattactagaaaaaagggaattctgggtggagcagcaccatagctcctgttctcttgtgaccattgttttaagattattatttgtgaatctccttttgtttttatgatggtgcaaagagatagaggcagtgtcagtagtaaacaatatactgtgtaaactcatgggcaaaagcagtatcttgcttttcttctaaaagcagatttgtcaccagaccaaactaaaaggatcagattggtgcatcctcttccactgaaatgtctttgtaattatccaggaatttaactagagtgagttgcagtgggatttcttatctgtaaatagttttcactaccctcttctcggaaaggatgctattaaaaatgtcatcattttttatttgtgggaatgtatgtcaatatttttatagctgttctcacagtaatctgctgaacaaactgcaggaaaaacaggtggataggatttttcagataattaaactctcgaagaagacagatgtctgaacaaacaagtacctgaatcatcactcagttctccaaatctgtgaggttgcgggcctcttggctggctgagatggtagctgttatcaccagaaataaaagggcagagtttatgtggcttggaggaagggttccaaaaaaaactacgtagggggatttgagagaaataagactaaactcacccaaatgttctcttcttctaacacttcaaatatttgttccttgaagtttaaagaaatctaataacctggaatttaatttttactgctctcagttccacttctgaagcaaatatcataaaagatatacatgttttccattactatgtgaggtgtgtgtgtatgttgggtcttacttgagttatcattttccatttttagtatagaaatttgcatataacacaaaaacagaatagcttatgacccttatttacccattgcccaacctaaacagttgtcaacattcattgtttcattttgtccacctcttttgttgctggaatattttaaagaaaaatttcatacatctttctttcacctgcaaatacttaagtgtacatctcttgcagaaaaggactaatataatattcttcagggggcttctccaaagtagaaagtgaagtcaactttctagaatgctgacacgtgttgtgggactaccttagttagaactagattctttgattacttggccaactaacctcctgagtacaagttaaacccactctacatgtctttgtcagaaatcatttagttgcaatgaaccaaaacctactcacactagctcaagaaaggagacagcttgctaggaaccagagctgctctgcctttcatgttgatataggggctctctcatttctctttttccatctctccgagcattgtatgtggcccagcatagaccccagccctgatttaacatattttcaggtccagcatttatataggcttgctgtactgaatcttgcttcaaattatggagagaatgagaacctattttctggctagttgatgtgttgactggcctctagtcagatgatctatggccaggattagatagtactacagaaagggctgccttggggcaatgggcatggacagtttacagataaagaggactccagatggaacaggcacttgaaaacatgttaattgcattctaaattcttcatttcagttaacattgttacactgagtttgaagtagattaatcatacggaaattttagaaatttctttttacttgaaagaggcattgtctgaatttagttctgtggtctagatatgtttgttagttcgttagtagtgaaaatatgctggcatgtaatagataatccctatttcatccccctccataggatgacaataatctgttaaaacagcaacttaaagatttccagaatcaccttaaccatgtggttgatggtttggttcgtccagaagaagtggcagctcgtgtggatgagctaagaagaaaactgaaattaggaactggggaaatgaagtaaggaaaaagcaagacctccaagtctagagtgggcctcacaacttgagagttgtgagtgtgaggttcaatgataaactcacctttctaagttctgttaatggcaaatttcttttgtaaggttctccttatgaagttttcatgactgagacaaaagattgtttaatttatttgtctgccactgattgtttttacattttggatcttttttttggtatttaagagtaatatttggtatttaagagttattgtttcttgaaagttaattatatatggtcaggaagtagagccacattatacattttaaatagagaagaaacatcaaaagaaaacataattatttcaaatatatgaaatggacatttattcttggagcaaatattgttagcctgatatgagcctatgttttcagagtggcagcagtcatttgataaagcaataatttgcgcttaggagatggtcagtaaattgctatagattgacaccagtccctgcacacagctttttactctggagctaaagttaatagcatgtttgcagccagcatcaaaaattaaatgtcacatttataccatttttccccctccttactagcatccatagtccttcagatgtcttagggaaaagtcttgctgatttacagaaacaattcagtgaaattcttgcacgctccaagtgggaaagagatgaagcacaagttagagagagaaaactccaagaagaaatggctctgcagcaagagaaactggcaactggacaagaagagttcaggcaggcctgtgagagagccctggaagcaagagtaagacaagggcaagaggcacctggagggaagtgtttggcaaatattaatgtttttcagcaaattacaatgcttcctttgtcatgtaaatacaacataattgttgttattttcacttataacaagtcaagctgggtgtgactaaaactcaaccctgaatgtggttataatgtcaaagtcaggcttgtttgtgacattgtgttttccttgatttagaagcaaaggcaagttattttataacaggcaggtaaataatgccacattcctagagtatggtgtgttgccagaatctggtattttttgatgtgatgattttaatgaagaggcaaacattccaatgactcctagagatcgttcaagataaaaccattcctgacaactcattagtaaaaaattaagttacagcctgttgtaaaatgggtgataattctataaaaagtttttattttgcttaaaacatattttgcctaaaaatcattcttgaaattgtatttcttcacagatgaattttgataagaggcaacatgaagcaagaatccagcaaatggagaatgaaattcactatttgcaagaaaatctaaaaagtatggaggaaatccaaggccttacagatctccaacttcaggaagctgatgaagagaaggagagaattctggcccaactccgagagttagagaaaaaggtaggggagacttagaaaatgagacacataagtacctgctgccagtgtcctgcccactggcaactaggtcagctgagatgggtgtgatctgtagtcacctctggctgcattgctggcacagtgctgaacctgacctaggtgggacctggatgcatgtcattgaatcaagaagctaagaccatgtgttgtggtagatggaaacgagaattgagaatgtaaggagtgactttcaagttaattaggtggtacttaacaaatgatattgggaggagtttgactcctttgaaacctcttgtccagttggatacatccatgggaaattacttttaaactcctcatcatcctttctaatacccctgcctctctttaatggcttttctccattccacctcaaccatctactcccattgtcacattctggactttgtcaagtttaaaaattgcacccacctctgaaatcacaaactgaagtgtcttgctctgatcataaccgcttatcttgctggtatccacacacttaaaatttgtcagccttattgagcttccagttcattagcctcacccccacctttgctatctgttaagcccttgtctttactttcttacttgtccaacttaaattttgtggtctaccaactataacttttttttttttaacaaatatcctcaagttccttgcccttttctactgttttatttccctgacaaaactgaagctctctgctttctttgggccagcacttccactggttgttcctggagaaaaaagtcaccatccagtattgtggtgtcattataaactcatagttaccaatctcaaatagacaatatgacccttttctgtggtgagcttcctctcccatgcctcactgtttcacaccttctcattcctcacacctgctgtctgctttctcccagcctcagtgaatgccttgcttcatccttccctgagaactcttcagtttccaagtcctattgaatccatctctaaaatgtatctggaatatatgtcctttttccttctctgatgctagacccttgtgctgtcatcatctctcttctggatgactactgtggctgtctgatcgatctgtcacttctactcatgaccctgctccccagagcagccaagatgctctttctgaaatgtcaagtggctgtaatcagtctcccctcctgtagcttcctttgttcttaggagtaagaccaaaattcttaagcctacgaggcctacatgatttgcctctgtttagatctctccatttctcactgtgctcctcctatcattttctcaaaaatgccaaattcttgtgccaccatcctatgcccagggcctgattcagtgatttcaaaggcaggttcatccatgccgtggtggtagtgctaggaaatgtttttccaatgaatggatgaagttatgaccactaagattcttgactaagaagacctagtacaagtttctcacagttttgagatctattatttattcattggatatatgtggagtacctcctgtgtatcaagtattgttctaggcagcagtgaacagagtccctaccctcctggagcttacatctgaattcattcctgccaaatgattcatctgtttaattaatatttcttttattttagaagaaacttgaagatgccaaatctcaggagcaagtttttggtttagataaagaactgaagaaactaaagaaagccgtggccacctctgataagctagccacagctgagctcaccattgccaaagaccagctgaagtcccttcatggaactgttatgaaaattaaccaggagcgagcagaggtgagttcacatgtacagaacaggtttccatcaatgatgctgctgtcaaaaaacatggcaacttgtattattgatcttgctatagacattggttattttataaaccactgtaaagttgtctgtttttcttaagacctaaagattatattccccccatcacaacccccaataatttattttgtgctgccatggatactgcgttctactgagccctgaaaggaatcatcaaataaacatgctatccctacctttaagtgtaaggatgcttagggaggtagctgtcaatatctacctggacaagggttcctgaaggattgttatataatccctctgaatctcaaatttttcatctcgtgcagtcatgtgaaaatgttacttcatagtatgactccttactgagctaatgtctgttactgtgctttataggatgcaaatgctaatgagattaagatagcagatcataggagacaaaaatctaatgatgagagcccagagagacataatcatggaagacggtagtaaaagtaaaaaagtaaaaaaattagcctttgttctttctgatgccgcaccttggggttgggagctgggcaggctgcccaacaatgggaacaacacaggagaaggtggggcttggatgtcccttttcatggacagcctggtaggcaatgtgatgaaagcagaagaatcaatccaagaggaagaaatgaagaagacaacctgtgatagcagtggtgcctttctcatacttctgtcccagtaggagttgcaggaagcagagaggttcagcagaaaggcagcacaagcagccagagatctcacccgagcagaagctgagatcgaactcctgcagaatctcctcaggcagaagggggagcaggtcagtgttggtacccagagacctcctctttctcagattcttatcagttcctaaaagacaaaattactgtaggtgatgtctcaaagaattctgaagtgcaatcaatagttaataagtactttatcctctactgtgtgccaggcttggtgcagtttccaagtaatgcagtttcctcactgggaaagtgtaaataaatatagaatcataatcaagttgaaaggataaatgtgtttgggaaagaatgaattcattggcaactttgtatgtgtaatttttttaaatagtttcgacttgagatggagaaaacaggtgtaggtactggagcaaactcacaggtcctagaaattgagaaactgaatgagacaatggaacgacaaaggacagagattgcaaggctgcagaatgtactagacctcactggaagtggtaaagtattgggctttgatttttggcagtggttttgtagtcataaaattaaatcatctcatttgttttttacctttaactgttacaaatcaagtccatgcttgattcagagagctgtggtaattagcttaataagtaaaataaaataaatcagataattttaagagtattttctgtaagtgtgttactgggggacttggttgccaagataagagtttcgtatttgtgggcgagcacagtggctcatgcctgtgatcatagcactttgggaggctgaggtgggtggatcgcttgaggtcaggagttcgagaccagcctggccaacatggtgacaccctgtctctactaaaaaatacaaaaattagctgggcatggaggtgggcacctgtaaacccagctactcgggaaggtgaggcaggagaatcacttgaacctgggaggcagaggttggcagtgagccgagattgggccgctgcactccagactggatgacggagtgagactctgtctcaaaaaaagaaaaaaagagttttgtatttgtaatttcaaaataaataatgtttacaaatcagtttgcctttttttgacttaccaaagggcagactgaaagtcagctttgaggaactgataaaattaattggctctcttagaatctcttttatattttgagaaaggaagtaagtgatttcatatcaatttcatagaatgacttttctttacagacaacaaaggaggctttgaaaatgttttagaagaaattgctgaacttcgacgtgaagtttcttatcagaatgattacataagcagcatggcagatcctttcaaaagacgaggctattggtactttatgccaccaccaccatcatcaaaagtaggaattctgtggtgttgggaatgtatactgaattttcttgaagaaagtgtgacattgtccccttccccaaatttatgaacaggtaccaaaaacaacatttctatgctaagccgtgcattgaggttctgtagcgtttttaatatttgagatgaaaatagggccttcttggggaaggtgacagttgactgttcatactcgggcggtatgtgttagggtccttgaatgtggatgctctaaggagaaaaggtgatttgagcccagagagcctgctgaaatggacatagaattgtgcagagcctccgacagaaaaaaaggcacctggatttcatgtccttttaacgaacattcattcagtgtttactgaagcctaggccaagtgctaggtagtggtggggcatcacaatgaatggtaaagcccctgctctcaaagagttcattggccatgccagcataattgcaaaatggtgacatacctatgacaacagacctgacctgtattctctagttgcagagaggtattaaggattcatctgatgggaagttcaggaaggaatgcttcacaagcagggatgtgaagtcagcacttagcaagcagtgagcgttgggcttttaggagggaggaaacagctcgtatggaagaggagagttattggcttagcaaagacaaatagctttgtggggctagagggtttataggaacagtgtcagatgaagctgaaaagtagattggggtcatgcttttgtttttctttttgttttttgagacggagtcttgctgtgtcccccaggctggagtgcagtggtgtgatcttggctccttgcaactgctgcctccggggttcaagcgattctccggtttctgcctcctgagtagctgggattataggcatgcgccaccacgcctggctaatttttagatttttagtagagatggggttttgccatgttggccaggctggtctcaaactcctgacctcaggtgatctgcccaccttggcctcccaaagttctgggattacaggcgtgagccatcaccgtgcccagcctggagtcatgcttttttaaaagggccttagaatctcttacacttaattatgtaggccataattatgtaggccatgagaaatgggttgtgtactaaaatgatcagagctgtagtttaggaataatattctggctagtatagagtctatacttatggtagggtgagctttcggtggggctctttaaactgattcaggtaaagagtagaagccagagctagatcagtggagctgggaaagaggagatgagattaaaggatgttaaagagaaatggttagggcctggggcctgaatgtgggaagtgaggagaagactggggcctgaatgttgaaagtgaggagaagactataggctgtattcatccaaagcagaggggcctggtgctatcctgctagaatcagccgatgagcaatagtcagggagaagcagctcagacacactaggttctcagggctgtgtagacttaaccagacccctgaagagcagaatcttagattctcccagcaatcctaaaggaagccaactccttggtacaaccagagctggaggtggaagcagtataaattagagcaaaacatataagcctgagctgggtgagggtttagaggatgtacctacagactgagaaggagaaggagggtagcagagtagagctttaaagccatgccaagctcccaggaccacagaagactggtgaccccagatttcttcgaagttcactggtttcctttgcctcagtcactgggccatcaaggatgaggttaaaaacaaaacaaaacaaaaaaccactaggaaaaatgactacagagagaacagaggctgacacccgggagtctcatcactatggagaacttattttcatttctctcttggggagttgctgcataaaattaacccagtcaaacagctagataacatgctttttccattttggtatggccaaggacttgtgagttctagaaaattgtaccaaaagagaggataggagatggatgttttaaaatggcttttgaaaggataaatagacattaatttgtttgctttcaccacactttgagcccttcactttcacagaccagtctgatgtgaccccagccattacccacatagccctcctttctgcatggcttccctgaccctgccatgtcgatcaagtccagagggatgttaataagctgaattgtgtatggaactgcagtttatgtgaccatgtaatcacctcacttctgtgaaaaataaggataatgaaaagaagccaagttctttctcaaccttgctacatctcaactttgctgtagactttgacgtttcttaaaatcagcctttccatttataatagatagtgtgctctgctgtcatttgttttaggtttccagccatagttcccaggccaccaaggactctggtgttggccttaagtactcagcctcaactcctgttagaaaaccacgccctgggcagcaggatgggaaggaaggcagtcaacctccccctgcctcaggatactgggtttattctcccatcaggagtgggttacataaactgtttccaagtagaggtaagtcaaatcacataggaaagttgcatttctcttgcccgtttaataaccttttactgattctctgaaacccctaagacacaatccagactccttagctagctccatgaggtcttctgtgatctggtcttggccagcgacctcttgtcgttgttttaaaccctgtctggaatgtccttcctccttcccttcccatggtgatgcctactcatccttcagtgagacctaggtcctcaaacaatgctcctaaatggagccttcttccaccctgcttcacccaggctgactaagcagcctctttgactgtactggagcatggtgtcttgtgtccttgcatcacggcattaatctcatcctcctaaaatgaagtgttacgggtctgtcttccaaagctccagaggaagagtcagacctgagtaaatctttttcacttattagctgtgtggtcttaggctaattatttagctgctgtgaaactgttaatctgtaaaatgtgaatactaccttctgagaatttgttcattcagaaacttttttttgttttttgtttttttttttgagagggagtctcgctctgtcacccaggctagagtgcagtggcacaatcttggcttactgcaacctccgcctcctggaatcaagcaattctctctcctgtttcagcctcccgagtagctgggattacaggcgtgcaccaccatgcctggctaatttttatatttttagtagagatgagggtttcaccatattagacaggctggtctcgaactcctgacctcaagtgatctgcctgcctcggcctcccaaagtgctgggattacaggcgtgagccaccgtatgtgtccaggaagtgcttattgactgcctgctgtgtgctaggttctctgttgtcagtgatcagcaaacatatttcctggttttagggcagataagttagtaagctatcacgttggagagtgttacatgtcatgacagtggtaaacactgagtgctgtaagatcttgtatgtagcatgaattagatacccagatggtcacttaataaattaatgaataaattagcaaatgcagaaacaaaccaacagataaacataagaaaaactcaagtatcagccatagaaaatactttgaatccatgttttgagctgcttttcaaaaatagttttgacctttttttcagagttttattctcacatctgcagtatcttggcttaaatgctgctgttctctactaaatttgtttacctggtaaaccatgggggtaaaacactcttttgttgaataaactcttctgtttatttctttgaagatgcagacagtggaggagatagtcaggaagagagtgagctggatgaccaagaagaacccccatttgtgcctcctcctggatacatgatgtatactgtgcttcctgatggttctcctgtaccccagggcatggccctgtatgcaccacctcctcccttgccaaacaatagccgacctctcacccctggcactgttgtttatggcccacctcctgctggggcccccatggtgtatgggcctccaccccccaacttctccatccccttcatccctatgggtgtgctgcattgcaacgtccctgaacaccataacttagtaagtggaaagacatacaactctctttccacactgcttccatgggtgactgataaggttatatacttaatgagttgacctatttatgactggattatatggcaaagtgtgtttgtaaggctgatgtttagaactgtgcaagcattctcttattaaaattctcttataaaagcagtggcatgtgcctataatccgagctactcaggagactgagacaagaggattgcttgagcctaggaattcaaggccagccccggtaacagcaaaaaacaaaaaccaaaaaaacaaaaataccatgtacaggagttagggtctcaggccagtctacaaacctgggttagccatttaataacaaatgttttcagtccagaaatttaccgtttttacaaagcttatgtatttttctattgacaagtgttatattaatgtgtatgtatatattcacttactagtgcctgtacttgtacacatacatatatgtataatatgagtgtatacacatgtatgtgcacgtgtatgcacacaggtatggacagcatacagtaaggttttggtggggattatctctaggtaggatttatttattatttattttcatagtttatatttcggtggggataaggttttggggattatctctaggtggtgggatttatttattattttcatagtttatattttattgtacacaatattttgtattctgtttttcctacttaatgttataagcatttgtccatggttttacaaatgtctttaaacaatattttaatgactgtacaacatttctatatttgtaggtactgtagctgactgtaaattcttactgtatctcttaggctagattctaagaaataattatttcctaattactagattacttcctttttcttttttcttcttctttttttttttttttttttttgagacggacttgttctctttcgcccaggctggagtgcggtggcgtgatcttggctcactgcaacctccgcctcccgggttcaggcaattctcctgcctcagcctcccaagtagctgggattagaggcatacgccaccacgcctggctaatttttatatttttagtatagatgggggtttcaccatgttggccaggctggtctcgaactcctgaccttgagtgatcgcctgcctggacctcccaaagtgctgggattacaggcatgagtcactgcgcccagcctcattagattactttctgactttttggttctaaagaaataaaatggaatctaagctcctccttcagactcagaacacctggagttttttccttcctgtcttggcagattgagtggaagataaactagggcacatgtcaagtcaccagtcccattgtaataggtcagactagttttagagggtctgtgtgcatttacaagtttaactgtagtagtcactcacattcttttgcagtttttcttgcacattgtaatttgtaacaatttctttctattcagcatttttctataatctcttaaacgggttcttttactctccaaacttacctggctgtttatatagtttctcaggtgcacttttatacttcccttcgtttgcatgtgttacttcttcagcctaggtctttccccttccgttcgttcttcaaaacccaggcaaaacacctcttcctctgagcagccttctcagaacttttctcccatgtggccagaggaaggagagacttctgtctatctcttctgctagaccccgaactctttggaggcagaggttatccacaagaggcttggcaaatgtttctcagtcatagttggactgtttgaaaaattaaaggttctatttgtctgtcagtttcatccgtgacatttaactttttataccaaagtcttagaatctaccatcattttttgggccattgataccactttaaccacagttaatttcagcttttggcaggaaagagaggaaacatcctgtgatgtttcagcactgcatttttttccccatctcattcaggagaatgaagtttctagattagaagacataatgcagcatttaaaatcaaagaagcgggaagaaaggtggatgagagcatccaagcggcagtcggagaaagaaatggaagaactgcatcataatattgatgatcttttgcaagagaagaaaagcttagagtgtgaagtagaagaattacatagaactgtccagaaacgtcaacagcaaaagtaattaatatattttttataattcagacaaatacgatattagttcattaatgctgtcgaacagaactttctataatcttggaatgttcttgatcttctgtccaaaacagtaaccactagctcagtgtggctgttgagcacttgaaatgtggctgatggagctgaggaacagaatttaatttcaattaatttaatagccacatattgagtaccatattgagcaatacaggtctgagttcttttggccaataatacaaatcagctcttattgtagtccctcttggagagtggtataaccatttcccctctccagttaccctagctaaaaatacagcaggggttctcaactctttcttttccattactctcctgtgcttccagttggtctctaaatcctgctgactgcatccagagagctctcaaactggtccctttctgtcatctccccttctctagcttttaattagtctcatcctagcgattgtaatagtttccacactggccttccatgtcttctctcttggtctacgctgtatcttgacacactgcaaatctgactgttccactttcccatgtgattctcagtcccatcagaatatacacgacccttctccatctgaaatccacccgtctttttcttttatcacagtatttggtctggctcactactttcctgtggtttcctcaaacaccacgttttctcctgcctctacacctttgcatgtactgtcttctccctgctgacccccttacctaactccaacttgtcttcaaaataaaggtcagagatcccctctcttttttttctcattaaaagcctatttcttctcaggtgcccacaattcaaggttagcaaccttggtcatagcactgttcacacaatgttctggggagcccaggagctccttgaaggcagtagctggacctccatctctgtgtcccagcacctgtcatagggtcacttagtgaatgcagcatctgttgattgggttaattatgcaaaagcctatcttttgcagtagtccatgaattatgacagttccccagtttttgtcatttaacccagactggcccagaccccagggtggtagggaggcctgcagaggacacaagtaagtaagacgtggtcactgccatctagcagcagacatctgactaatagtcctggcaagtgaaagcaagggccacacctaaaagataggggctagatgtttgaaggttaggcagatggttatgtctgttatttttgtgggtatacacattggggaatggaatttttttactttgaggtattttggagggagatgatagggtggtaggattgccacttcttttcatagttataaaagtgtaataaatactattctaggaagtttggataacacaaaaatgtcccaagaagaaagtaaaaatcatatgtatgccttcatttaaagataatctgttaaatgttgaatttattttcatatttttctgtcatgcagtcatacatagctaatctaattttcaaataatttcatcatgttagccttaagatattgaattgtgtgtcacagtttttgatgtgtcaaatgttgtcaccagagttttacttcagccgaatggaataaatcacaaaatcaggtagtcttcaagggcagcctatgaactgcccttgaaggatagttttgagggaatggatgaatattgtggtagtggtttgctttatttttatacctcaaaagaatagaagtatcaacattttcttggtcaagtgctgacaacacaataatctttgttgttatatttaaaagggcaaacaattccatgtcatgcattttacatattatgcatttattgccaataggaattccatgtttaataagatggtaaacctagaccttgaacaaaatcaaatgtagcagtctttcttacctattctcatataaaattagaaaatcattgtagatctttttagtagttaggctacaagtatctgtattgtctacatttaacattttttaatgggtgtatatattattttttagggacttcattgatggaaatgttgagagtcttatgactgaactagaaatagaaaaatcactcaaacatcatgaagatattgtagatgaaattgagtgcattgagaagactcttctgaaacgtcgctcagagctcagggaagctgaccgactcctggcagaggctgagagtgaactttcatgcactaaagaaaaggtttgtcttcttgtggtttggggtgtgagctcagtgtgggtgagtcagcttactgtccacctgaaggattagaaagagaatgtgtgtgataagaggacagttgtccaagtcagacagccaggttccaggctggactctgctagttaagaagatgtgagaatttatgcaagtcatataagtcccctggctttgcttttcttatctataaattcaggctaagaatacgtaggcttttcggcatggattaaataaaacagcgtatttaaaattcctgaagttacttagttcctagcacaccccacgtccttatcctgtgtgtatcttttatatttaattatttgggttctgctacctgtgtttttttaaataggtcaatctttatattcttattaagctacaatggacctcacaagtattactttggtcttcaggttgataatgatacaaaatattttttggtcagagataattttcttttttttgtttgagatggtgtctcgctctgtcacccaggctggagtggagtggcgcaatcttggctcactgcaacctccgcctcccgggttcaagcgattctcctgcctcagcctcctgagtagagacggggtttcaccatgttggtcaggctggttttgaactcctaaccttgtgatcctgcctcagcttcccaaagttctgggattacaggcgtgagccactgcgcctggcccgataatattctttagaccacaacacagagggaagttggggagaaaaaggagttaccttttattgagccactgctgtggctacacatggccattttgtaaatgtttcatttaaccttcctggcagccctgtgtagatgatgttagcttggtttactgatgtagctcagagaggctcattactggcccagagtcacatagccaagggctcttttagttagatgagaattccaggatgaaaagagttccttacccacatgaaacacctcaggaactattatttgtattttgctatttcaacatgaatctatttaaattaaaagcagtctattacctaggaactaaattatttattaaagaaattctgtgagtaattaagaatggaaaaagtccttttcagatgagctgttccttctgttgtcatatgttggattactgtgagagaaaatagatgtgagcagaactagaggaaaaaaaatcactggtataataatatataataagatattttgataatatatcaaaatatcactggtatattttgattataaattttggtatattttggttatatattaatatatataggtatagatatataaaatcatcaaaagaaaattgatggcagtggtagtaggcagaggtagtaagtcaaccaaggctggtaagttctttcaccttcatcctcccaaaatgactcagggaggcagcttggtaagaaggaggaggagagagaaagtagtggtgttttggaaggagtgtgccagacatgttaaaacctgacatagaaggagacaaaaaactatttggtggcttttctggaatgcatagccagttttatccagtgctttgctggtgaaactgacagaaacaagctatctgaaatggaaagacgtatggtaaaatatgtagctctctgggagcttgccaacccttttgcatccacacagatatttaataggcaaatttaacatacggactcctctggctttagtacaatggcagacttcagttttttttggctgaaggtgagtcactgctcaaccaagtgcaaaccacactctatttatttttggaacttttgatgtcattgttttaagcatcttatgttaggcagaaaaagaaaccaagttgattaaaacaaatgtgtttttaccaaatcttatataggaagattttaaacatttgcaaagtatttaatgtttgtgtttgtcagccgtaattacattatcaccagatcaatgcatttttacttcgcttgataataactatagagtgcagcaagaatttctgtgtggaggaaatcttggtaaaatcacttccttcccacttagttgggtagatagttttaatatttaaaatgatataatagtattacagattattttgaaataaaaagcatctttagttccactactttcaaatgactgtatttatttttatatagtctttctgtctttgttgacacatgtagttttacacagttgctctcacagtgcttataccattttaaatttatttttctcagccaacataatattaacattcttccgtgttgctacattgtcatctgatcatttgaaaggctacacagtattccactttgttaatgcattatcacttagcctattattatttgtcaggtcttatattattatacattgagcatttttatatagtagttctttgcttctgaattatttaccgagaattagagttacagtgaatggacatttttatgtctttctgtaccatcttgttttccaaaagagctgtactggtttacatggccagtagctgtgagtgagtattgtaactgaatggcttttaatgacagtttcttttctagacaaaaaatgctgttgaaaagttcactgatgccaagagaagtttattgcaaactgagtcagatgctgaggaattagaaaggagagctcaggaaactgctgttaacctcgtcaaagctgatcagcagctaaggtaggtggattccctaagccgttgatgtatacattgagatgaatgaaaagtttgcttctaaggggataataattggtttatgataaataatgcatggtaagtctacaggacctggggggaataaagcaatgtgctttagatcgctccaggctgatgcaaaggatttggagcagcacaaaatcaagcaagaagaaatcttgaaagaaataaacaaaattgtagcagcaaaagactcagacttccaatgtttaagcaagaagaaggaaaaactgacagaagagtaagtaaggcctctgtagggctacaaggggtttgtgctggaagacagctctggggttccgagtcccttaggatctgctctagtgttgctggtgctttgtaggcttcagaaactacagaaagacatagagatggcagaacgcaatgaggatcaccacctgcaggtccttaaagaatctgaggtgcttcttcaggccaaaagagccgagctggaaaagctgaaaagccaggtatggcaatagacaccttgaaaaaacaactgacacagcactttatgattataaaagtaatacatgtttaattgtagaaaagaataaatgcggctatgtattatagttgttaagcatgaagtctgaactaaatttgaatcccaactcaatacaatacttctgaataaaaaaagtgggtctcaaaacatggtatactctatgagatcatttctgttaaatgcctttatcaacacttatggttgtatttttagtcaataccaaagtacaaaagtggtcatctgataaggggggattttgagtattttctgttgtcttccttttgcatatctgcatggtcttcttttttttttgtaaacaaatacgtattgtctttaaaattgcaacgaatttttaattttaaaaatgaatacattttaaaaatctctgactaacttccatcaccaaggatgtcaaaatggaattagggtataaaaataaaagttcttggaaaactgtaacctgagggatgatcatgattatcatattgttgttcttactgtgatcactgtgatttgagtggttttaagtatgtgagctcaaggttttcattaggcatttcacccttgcactccttgcctggcttttctgactcttgggggctaggatattagctcctgattttacctcacaactaaattatctccaggttagcactgagggctgtatggcctttgtcaaacttactcttcccttttctttaatacaggtgacaagtcagcagcaggagatggctgtcttggacaggcagttagggcataaaaaggaggagctgcatctactccaaggaagcatggtccaggcaaaagctgacctccaggaagctctgagactgggagagactgaagtaactgagaagtgcaatcacattagggtgtgttttttattagggttttctgaagagtcgtaggacagtgctataggtttactttgatgtattttcattgcttctccccaaatgaaaatataaattcctgaaatcttgcctcctctgtaaaatcagtttggtgttgttacatatccatgcagtggctgtcatgtgtagttccccctctgttgttttctggatatgctcaaagttctcctgcccctgtacctttctcataccatttcttctccaggaattccctttctcccctatcactagccagatcccacctgtttctcatggcgcagcttcatgccacctcctcttagaaaacttctggccgggtacagtggctcacatctgtaatcccagcactttgggaggccaaggcaggcagatcacgaggttaagagattgagaccatcctggccaacatggtgaaaccccatctctactaaaaatacaaaaattagccaggcatggtggcatgcgcctgtaatcctagctactcgggagactgagataggagaattgcttgaaattgggaggtggttggttgcagtgagccgagattgcaccacggcactcttgaacccgggaggcggaggttgcagtgagccgagatcgtgccactgcaccctggctggtgacagagtgagactcaatttcaaaaaaaaaaaaaaagaaaacttctctgacctttttctttcttctggaagaaggagtttccttcttttgagtttagaaacactctatctgcatgtttcctagggcatgaaggcctagccttttgtgatcatgtttatcttccctgccttaccactcaacaaggtactaagcccctccagagcaggagccatgtctcagtcaggcttttctctctatagacgttgccttgcttacagtaatgttgcaaatatatttagatgaagagaatatgttactttcttctattatatagaaataggtttctgtaaaatataatgctgttcttgacataaaaggcaaaaatgagcttgtttccaaattagaatttctatgatataaaacaataaataacagaacttattttgaagtaattttcatttacagtcacaggagggaataactttttttttttcaaacacaggaagtaaaatctcttctggaagaactgagttttcagaaaggagaactaaatgttcagattagtgaaagaaaaactcaacttacacttataaagcaggaaattgaaaaagaggaagaaaatcttcaggttgttttaaggcagatgtctaaacataaaaccggtaagtttaaaggaaaacaatcatacaaagtttgaggttggaaatgtctgtattacaagtcacagaaaaaataacaaatggccaaaaaaactttaaagtttaaccttactgctaataagcaaagcaagcaggttataaaaggaatatgatattttctgccattttaattgataaactttatttaaaagcaaaataatcatgctcattgctgatcagagtgtgctgaaagaagagcactcacagtctatcaattgaggtataaactggaacaatctcccagtgtttcaaggctcttaaaattcacacctgttgaactagtcagcccatttctactcctccagaaagggcaagtatgtacatcgcagcaatatttataatgacaaaatttggaaacaggctgggtgtggtggttcatgcctataatcccagctctttgggaggctgaggcaagaggattgcttgagcccaggagttcaaaactacctgggcaatgtatgagaccccatctctacaaaaatattcaaaaattagcgatgcacattgatgtgcacctatagtcccagctattcagaaggccaagcagggaggatcccttgagctcaggagatcaaggctgcagtgagctatgattatgccactatgcttcagcctgggaaacagaggaagaccctgttccaccacaccccccaaaaaattggaaacagatgaccaatttaaaagccatatttttaacctttaatgacatgcaaacatgaccatgagaagaatgaaaaaaagtaggtaaaaaatgaatatggagtatagtcccagtttattttaaaatgtgtgagagtgtgtgtgtgtgcgcgcgtgctcacgcgcacacacatgcattcttagaaggaaatacatcaaaatgctattgtaaaagtgatttggggtggtgaaataatggtgggttttcatttttttctcttatgctttttttttgtattttccagcttttctacagtaagcaagtatctctatgatcagaaaaaaagttaatatttaaatatctgtatttcaaaggccaaaaaattgttatataaatctcagtctgtatttcaaagtatttttaatttattttgatcaattttatataaaatgcttttagttgattcttttatgtagaagcaaatgctttggaaccagatctttgttaattaaatgtttttgttaaaatgtttgtctgtttatttatttatatagagatgggatcttgctctgtcaaccaggctagtctcaaacccctgggctcaagcagtccttacacctcagcctgccaaatggctgggattacaggtgcgtgctgctgcacctggcttgttaaaatgtttttaacaaattaaatagtatttagcgatacttttagagaattttttattaaaaataaaattagcaccattaattcagctcaacaaaatttttaaaattgtcttgtattagtcaatagcattgttttctgtttcattttgtaaatgttttccaagttcatttaatatcatggaccatgctttgtttctatcccttagaactaaagaatattctggacatgttgcaacttgaaaaccatgagctacaaggtttgaagctacaacatgaccaaagggtatctgaattagagaagactcaggtggcagtgctagaggtaatgaacaaagccagtgtacccttaagaaactgaagtctttctcatttaagatgtttgagtcctcttttatctgatttaggagaaactggagttagagaatttgcagcagatatcccagcagcagaaaggggaaatagagtggcagaagcagctccttgagagggataaacgagaaatagaacgaatgactgctgagtcccgagctttacaatcgtgtgttgagtgtttgagcaaagaaaaggaagatctccaagagaaatgtgacatttgggaaaaaaagttggcacaaaccaaaaggtgagagcaagaacaaataagcttgcaggatcacttcttcaggccaaagcattataaacacactataaaaaatttggaaaatagagaaaaagataaaatacaccacaaacttggtatcataatacattttgccagttgcatttttttggagaatttccttctagctttttttttttttgctcaaaagcatttttttaaaatctattttgttttttttaagtaaaatgatacatgctggaaataaatggagatatatatcttgttcatggaccaaaagacaacattgttaaagatttagttctgttcaaattgatctctagattcaaaacagttaacaattaaaatctcaatagcctttccttgtggaaattgacaagctggttctaaaattatatgaacctagaatcgaattattctaagacctagaatagaatttatacaattttttaggtatgacaccaaaacaacttttagaaagtagaacaaaaatttaggactaacactacctgatttgtaacacttttataaacctgtagtaatcaaaacactgtggtattagtgtaaagataaacacatagatcaatggaacagaatagaaagtctagaaataaactgacatatatgtgaacaactgattttgataaagataaaaaggcatctttttcagtagagaaaagatggtcttttagaaaaatgttggctgaaacaattggatatacaaaaccaaaaaaagaatctcaattcatacctcactatgtataatatataaatatgaatttaaaatgaggccaggcacgttggctcatgccagtaatcccagcattttgggaggccgaggcaggaggatcacttgagcccaggagtttgagaccagcctaggcaacatagaaagaccctgtctctgccaaaaaaaaaaaaataataataaaaatagccaggttgggaagctgaggtgggagaattgtttgagccagggagattgaggctgcagtgagccataatgataccattgcactccagccagggtgacagagtgagaccctgtttcaaaaaaaaaatatatatatatatacatatttattttatatttatatataggaccataaacatatatgtaaaacctaaatataaaacttctagaagaaaacataaaacatagcagaaaacttttgtgaccttggagtgggcaaaaattcttggtatgacaccaaaagcatgatccataaaataataaattgataaaattagacttcaaaatttaaaacatctcctcaaaagacacaaggtaatgaaaagatatgtcacaggttgggaaaaaaatatttgcaacccatgtatctgataaaggacttgtattcagaatacatgtataaagaactctcaaaactcaataagaagacaacccagttatttaaatgggcaaaagatttgaatagacatttcattacagaagataaatggatggcaaataaacacatgaaaagatacgcaggataattaatcattagagaaatgcaaattaaaaccacagtgagatatcactacacacctattagaacaacagccataccaaatgttaatattaaccaggaactttttttttttttttttgagatggagcctcgctctgttgcccaggctggagtgcagtggcgctatcttggctcactgcaagctccaccttccgggttcacggcattctcctgcctcagcctcttgagtagctgggactacaggcacccgtcaccacgcctggctaattttttgtatttttagtagagacggggtttcaccatgttagccaggatggtctccatcccctgacctcgtgatccacctgcctcggcctcccaaagtgctgggattgcaggcatgagccaccgcatctggccggaactttcatatatgattgaggggcatgtaaaatggtattaagtaactgttaaactttggaagacagtttaacagttacttaaaaatcaaacatacgccaatcggaagatctagccattccactcctaggtattatatttattcaagagaaatgaaagcatatttctacacagtatatatgctaatgttcatgacagccttatttgtaatagccaaaaactagaaatgacccaaattgtctatcacctggtaaatagataaacaaattgtggtatatccacactgtagaatactactcagcaataagaagggaatgaagtattgatatacacaacatggatgaatctcaaagtaactacgttgagtgaaagaagccagaccaaaagcaagtccaaactgtatgactccctttatgtactacaatacatgctcatgcatgtctgctatatggacagatcctactgtacacacaattgttttctactctttcgattgtcacagctccatttttatcagatttttggaattctgaatgttatccatgtttttaatccatgatttttataaaacttcaatttagtgagtcagtttttgaaaaaagtctccacttagaaagctgataataagattctgaaaatgagttgagtcttaaattttgtgaagatttataatcatttatactttccataactgtatgttgtgaaaggataacactgttcctcagtcatctcctgtgtgtgcttgtatatttgacagtctgacttactctctgtggtagggttttagcagcagcagaagaaaatagcaaaatggagcaatcaaacttagaaaagttggaattgaatgtcagaaaactgcagcaggaactagaccaactaaacagagacaagttgtcactgcataacgacatttcagcaatgcaacagcagctccaaggtataaggcagcaaaacagtgaaagtgtgtgatttccttgcccttcgttagattctttgatttttcttacgacaagtaattcctgctaatgagcatggtgtttctttctaaaattagattgtggtaatgtttgcacaacttggaatatactaaaagcctttgaattgtacactttaaataggacatgatatgtgaattttatctcaataaagtcagttaaaaaaaaaaacctaattcatgttccttagagaacaattttaaaacagcaaaaagaaataaaaattgctgttgacctcactcctcatagattcctagtaacagtttggtgaatatccttccagatttttcctaggggtgtgtctagtttgaaaaacaaaaacaaagatgtaaataatgaagattttaaaattaccaaatgtttataaatatgataatttatttagaagaaattgctgagtaattctagctaataatatacttgttgaacattttttatatccttggtatttcattttctcacttaatcctcataacatttttatgagataaaaattattttactcatttgtaaataaggaaactgaagcttagttttcttgtgactgcttaaatgagaagtgacttgctagaggtcacacagctagtaattgacaaagccaatatagataaaaaatttattcccaaattgccttcctgaaaggttaagtttctatttctaccagcaatgcagaaggtagctgtttttaaacacctaacattaagtattatctgtaattttttcgttgtgagattttgaacatgaaaatctttaaaaacctgagctccaagcccaaatctggattgtgcatgtaactctcttttggcctttaatgagatagtgtggcatagtcatacatgtaacaggagtaagcttaaaacaacttctctactttttgggaatgctaatgggaatctgtacagtaaatacgtatgtatttcttatttcatgagaatgtcatttctttagaaaaacgagaagcagtaaactcactgcaggaggaactagctaatgtccaagaccatttgaacctagcaaaacaggtaaggttaacaaatgtaatattctagtagtatactgagggtatgcagaccattggtttaaataacaaagaaatcaagtaggctggttcctcttcacaacagcagataccgtagggccatttatgtaacataaccatcacataaataaaagttttgatggagagcagtggtttgctaatttattttagccttagaactcttgatacaaacagttttactcaaagctagtaagtagggtggtggctagaccagagcccagcagcagtctctcagcagcccttcttggggtttcagggaccagatgggccatctctcatccatgacacagatgaggcctctaaaggctgggcttagatttgattactccttgagccatagagtacccgccaaatctgggcctctatcttgtcagatattgaatatagcagatttttgaccctcatacttctaatgattttcttaaaggtaattcagtgttgtcctgtgagactagtgctgtaattcaaagcacttcaaacaagttctagacttcagtttctattatgtaaattaagagttatgccaggtgcagtggctcacacctgtaatcccagcactttgggaggccaaggcgggcagatcacctgaagtcgggagttcaagaccagcctgaccaacatggagaaaccccatctctactaaaaatacaaaattagccaggcgtggtggcacatgcctgtaatcccagctactcgggaggctgaggcaggagaatcgcttgaacccgagaggcggaggttgccgtgagctgagattgcaccattgtactccagcctgggcaacaagagtgaagctctgtctcaaaaaaaaaaaaagttaacattagacacaggccatcccagcactttgggaggccaaggcaggtggatcacttgagcccaggagttcgagatcagcctggccaacatggtgaaaccccgtctctacgaaaaagacaaaaaattagctgggtatggtggcatgtgcctgtagtcccagctactcgagaggctgagacgggaggattgcttgaacctgggaggcagaggttgcagtgagccgagatcatgccactgcactccagccttggcaacagagcaagactgtcaaaaaaaaaaaagttggattagacatctaaattctcttgtacctgtaagtttattgagataataaaggaaataaacttttatgcctctcgttctgtcagacttagtagatactggattggcactgaccacctctagtaaagatggctttattagtagtttccacttgttctttcacctaaaggacctgcttcacaccaccaagcatcaggatgtgttgctcagtgagcagacccgactccagaaggacatcagtgaatgggcaaataggtttgaagactgtcagaaagaagaggagacaaaacaacaacaacttcaagtgcttcagaatgagattgaagaaaacaagctcaaactagtccaacaagaaatggtactacacatttatgattttacataaaaaaagcattttgtggctcatgtgagcctatttttcccctggcagaaagctgctgagaaatatccccaatgggactatgtgtcccttaactgccctgtgtagccatgggtggcatttataccaactgtgtgactctcttacagacctttaacgatcatagaacatcagtcctgtaaagatacttaacagccacgtgccatttgctgcttgaatcccctcctcacatgctggccagatagcttcccaagccctcttgatcacctctgtaatggaattgtccctgtgggctgtcttctactttcttttgacctggaatctgtctcatgtccatgcaggttctctgggacactatttgttgtttaatgactaatcaagattattctttattaagatgtttcagagactccagaaagagagagaaagtgaagaaagcaaattagaaaccagtaaagtgacactgaaggagcaacagcaccagctggaaaaggaattaacagaccagaaaagcaaactggaccaagtgctctcaaaggtgctggcagctgaagagcgtgttaggactctgcaggaagaggagaggtggtgtgagagcctggagaagacactctcccaaactagtatgtattctggaacttctcactgggagatggggtatggattggctctgctggttgtcttgcaaaagtatttaaagagatccggaccccagccagagcccaggagaggaggcaggagaagtaaagcaggaggtatgatagccctgtgaaagatgaggaagcaggttcagaggagatacaatcctgagactgaccagcaagtccttccttgctcatattgtctcctttgagaatgccatctcaagaaagtggaacattcacgtgaataattgccaaaagatactcttaaagtatattacctatgagctttgggaataatgatctacttcatctcaagtgtcaaaaaaatcatattaacagttcttttgtccagatttggcatagtgaatggtaccagaatacaggtgtttgcttttaggtcagtttgttctctcttgaaccatatataaatgaagttgacgtgggaatccagggtaaatgattgttctcacatcagtaaatggtttttctctttcttaggctccagggtttaataatgcttggaaaatgttgtgggcttggggatctgaaagggttgttattcctttttccctgggaactcttgatatacccagacccaatcatttcattatgaaaatgaaacttaaaaaaatatgtcgagttctgatcatgccagagttgttgaaaagtaaaatctgggcagggtgctcctctagggtgataagaaaaatattttttaaatgtcacttttatttcgtaagcattatctgtcgagtactcactatgtaccaggcgtttgcacacattattccaattgaacatcaggaaatgttttcctcttctataaaatggggctcatgccagtgtaggagccagctccaaatcctgtgcactttccactgcactgcctcctgtggaaggaagtagtactggtgtgtctccctttatgaaaatcaatgtttataaaaaacatttcagctgttccacacacttcaggattggtgctgggtttcctctcactggtctcaaagacttgaaagagaagatagtagctatctgtcactctgggatcaggccctccaggaaccaattacttcaaaaggcacccttatctgggttttttctgggcctttggtgtgggtcagggtaggcttgtacgactttgtaatggaggaaagcacctgcatgggtagcatatcaccattatgcatctgccacaagggaaggggagctctgcccacagctggctcggggtctttggctaaacctactgaaaatgctcatttcagaacggcagctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagcggagccagctggagaaaaaccttcttgtgagtacctgctgccgtggcagtttgtgaggaaatgataaatttaaaattttaaactgcaacaccacttcaacacagagaaaataaattacccatcaacccagtcctgaacccagctgttgttattgatgtatttatgcatcatttgtccttgaagttgatggtaagttttacctgggacgggtgcagcctcaatggagctctggctggctggggagactgttggtgtgaacagccattatcagcacaaagtagacagcatgttctgccagcaagcctcagtttacacctccactggcagggaggagggggtgttgaagaagccttctctagacggttgttttttaagatggcatcttgctttgtctcccatgctagattgagtggcgcaatctcagctcactgcagcctctgcttcctgggttcaagcgattctcatgcctcagcctcctgagtagctgggactacaggtgtgcgccaccacgcccgactaatttttgtatttttagtagagatggggtttcaccaggttgaccaggctagtcctgaactcctgacctcaggtgatccacctgcctcagcctcccaaggtgctgggattacaggcatgagctaccgtgcctggctcatagagagtttatttttatttttattttcaagacagagtcttgctctgtcgcccagtctggagtgcagtggcatgatctcagttcactgcaacctccacctcccaggttcaagcaattctcctgtctcagcctcctgagtatctggaattacaggcgtgtgccaccatgcctggataatttttgtatttttagtagagacggggttcaccatgttggccaggctggtcttgcactcctgaccttgtgatccacacgacttggcctcccaaagtgctgggattacaggcataagccaccgcgcctagccagttttattacactgctgtagtcagtgcctacaaatttttctcatcctgccctttttggccaacattagctttaatcattatcctaaaaccaggaagctcaatctaccatgctttcatccttgaaataaatttgggaagtgacactcaggtcagaataatttatggtggatggagacaggtgagcagcaatggaactgtcaagggggaggatttttccactaccctctggaggggttagtggagccctgttgtatgaaaggaacttttaaaccatgtgtgtctctcaaaggggatacgctgataactagtgataggcagatcgtcataaagatggaatatagatgtctaaaatttaatcctaccagtaaccctgtgatgatgggtattattattctcattttacagacaattaatgaagactcagaaagggatagtagcttattatcaaaggtaatgctaacagactctgacgtgtatatacgcccagctgtatttgatctgcccatgaaaggccgatagaattatccccatttgacagctagagaagctgaggcccagaaggggaatgaagttatagagctagtgagtgtgtaagccagcaaaccacacctccatgtgttagatcgcagagttattttcttcctcctgtgctaggagcaaaaacaggagaacagctgcatacaaaaggaaatggcaacaattgaactggtagcccaggacaaccatgagcgggccaggcgcctgatgaaggagctcaaccagatgcagtatgagtacacggagctcaagaaacaggtgtgtgcccagaaagcccagctggccagcctggggagagaggactcactgggctcaggcagattgtattgtttttaatatcccttctatagtagtatagaaaagctgattataagaatgttctttaagtcaaatctggttttttagccttaaaatttagaaacacaccttgactattaaaaatataaatttctcttaaatttgacaagctcttaaaatgttagtttttcaaggaaaaaaggtaattcttgagcatcatatttcatgtcccaaagaactatgttgaaatgctagattttatgccataaacaagtctataggagccaaaacctcccctaccccttgagcaagaaaagatggtccgggggaaacctttgatatcacataatgtagccaggcagagagtattaaaccagttcatgcctggactggtagagtctctaatccttgatatctctggtgtcctttagagcatctgggccatccctgaactctagtcgggctgctgtagccactcatttggccctgctatacttagtcttttgggtgaccccacgtggccattctagtttcatctgtgcttccaatcccctgatgccccacatatacccaccatttaattcaagaaaaaataaccaaaaaaaaattatttaaagaccacaagcccttagtgattttgcctttgcaaatttggtaaggcaattagcagtaggtataaatttcatatttcactaagctctatatggggtagagccacatagagtagtctcaggcatcaaatgcagttggtaacactttaagaaacctctaggctgggtgcggtgctgcattcctgtaatcccagcactttaggaggccaagataggtggatcgcttgagctcaggagttcaagaccagcctgggaaacatgccgagaccccgtctctactaaaaatacaaaaagtagctaggtgtggtggtgtacacctgtagtcccagctattcgggaggctgaggggggaggattgcttgagcctgggaggttgagactgcagtgagccaagattgtgccaccgccctccagcctgggtgacagagcaagaccctgtctttaaaaaaacaaaacaaaacaaaaatgtatattgccaagccaccagattcttcacttataaaattccagcattagcatttataatccagatcacttatgacttatttcagtaaatggcccttttctcatttgtggcttatttactctagttgccagttgggtgccactgaggtgcttcatgtaaattctcacttagtttttacatttctgagcagaaggtatttatctccatgtataaatgaggtaatggaggatcagatgttagccaacttgccctgtcatactggtaatactggaaatcagattggtaactagctttgtctgactccaaagagattgtcttctatagagtaattcaccttcaaggaactttatgcacatggcttttctaaatgaaagttgttccagttaaaatgccaataaaataatttattcagtagcttatagagtcttgagtatctgaaaaatcacaagtttttacagttctagtaatcatagtagttgatatttatagatctttaaatacatggcacatcatacagctcaattccaagtaagtctgaaattttatacaatgatatttgacaccaactcactgtttagatggcaaaccaaaaagatttggagagaagacaaatggaaatcagtgatgcaatgaggacacttaaatctgaggtgaaggatgaaatcagaaccagcttgaagaatcttaatcagtttcttccagaactaccagcagatctagaagctattttggaaagaaacgaaaacctagaaggagaattggaaagcttgaaagagaaccttccatttaccatgaatgagggaccttttgaagaaaaactgaacttttcccaagttcacataatggtaagggtttatcctgctattctctgggttcgtaggattgaccacctcccccagctaagctaaaacacagatgtgggggtgctggggtaggggagggaaaggctggttggcttccatttgtagcagcagatgattcatgatatctctattttccctctgagaaaggatgaacactggcgtggagaagcactccgggagaaactgcgtcaccgggaagaccgactcaaggttgccctttaaaacaaacaaaaaatcagtatgagatactgggcacattggggaggggaggggaaagttacatttacctgatgctttcacatccatgctgttgcagccctgccagcagtgtcagggatggcatgtctgaagcttcgaggagttggtgtcacacagtaaatggcaatcagtgttcaaaaccatgacttcttgtgttgactccagtgttctttaacctatgtaatgctgctttacctcagctagaaccgatagaatctaagtatttgggagaggaagtagaaacacagtgatgaactgtaaggttatcataggccagtggtggcaggaaagatttgggatactggaaaagtaggctgaatgtcaggtaaggaattgtttggctcagaacatgttgactttgaaggccttgtgagatatccagggaaggatatctgtctgtaggcagccaaaaataggagtctaggattactgatcagtgttgacctaaagatttgagagttaagagtataggtgggaggttacatttatgtggggggaatggctatgtagacagcatgggatgagagagtgcagtgctatagtattgagtggagccctgtgatgtccaacaatagtctccagccatgtgtggttatttaaattttaataaattataattaagttaaaaattcagttattcatttgccacatttcaagtgcttaatagccacatgtgtctagtggcttctatatttatagccagaggtagaacattcccatcattgcagaaagttctgttggacagcgctgctatagactttgagagaataatttgattatagcaggggcaaaagccaaaaagtagtatgaagttgaggattaaatacctaatcatttatagacaagaaactaagacttaggaaaaaatacataatcaggagacactccagttgtcaagtataaactgatcttctcagtcataacagaaaaggaaaaaagagatgaggcaataatttaatggagaagcaagggatacagaaatcctaagcactgctagcatggaaaaactgggccaagtgaaagaccccgttaatgacaacacagaaaagtaaaggtttatgcacactaagtatccacctggcacctcctacaattctttttaaagatgagcatttttgacagccattcctactgttagccagatttgcctatcaaatgtatgtgaggaagctgagcggcagttctggtacatttcttctgtgtaaaaccctaagtcttatcacacttttcaggcccaactccgacactgtatgtccaagcaagcagaagtattaattaaaggaaagcggcagacagagggcactttacacagtttgaggagacaagtagatgctttaggggaattggtcaccagcacctctgcagattcagcgtcatcacccagtctgtctcagctggagtcttccctcacagaggactctcaacttggacaaaatcaggtaagcagcagctctttttaaaaacaaaacaatagcctgaggttgttttttgtcttttttgagacaaggtcttgccctaccgcccaggctggagtgcattggtaccatcacagctcactgcagccttgacctcccaggctcaagtgatcctcccacctcagcctcccatgtagctgggactacaggcacacaccacttggcttggccactttttaaaattttttgtagagatggaggtcttgctgggttgccagggctggtctcaaactcctgggctcaagcgatcctcctgcctcggcctcccaaaatgctgggattacaggcgtgagccaccacgctgagccaagaggaaactcgtaagataggatttaatatattacatagaaagtacttaaaagccgtggggtgtataatctagaggagattcagaaaaatatagattatgccgccttcaactctctgaaaaacttgtcttagcaaagacttggtagaggtagataagctgatggcttaggaaacagactacgactgcagattggatgacctggcagggatatagttaattctactattcatgtcctccacttctggatttatttatttcctactctgtcaatataaagagcttagacctgtgaggccaatatgagtcctagtttagtatgtctccctgcattttgtaacttacatttacagagttggaattcagacctcttaacctaaggtctataaaaaccctgaatttcacaaaggttttctgtgtgagcttagataaggttaataagcatttaagaggaacatgaaatatactcatggaactggtaagtagtagcacacacaactgtcagagataggtaacagcttccattttccagtgcctattgtgtgcacatacaaaactttatatatatcatctaatttttacatccttggaggtaggacttatccttttatatagataaggaatctgtacaaaatgataaatgatttggtcaaggacatagcaaaggacaacagcaggacttgcgggctaatctatctttaccacagagcagtatattttaatggtggagccacaaggagctttcaaggacagttgcctctttaatgtgcccaaggtgggcaagtgacttacctagttcacacagctaattagcagcagggccattagcagcagggccatctgaatatgattatcttaacaccatctgtggtggacccagtcaggtaaaggccaaaatcatcatgggccttagggcagggttcgaggaggagtgtgagaggcactgggcattgaatagggaagctttggggatgagacagcccagagtagtgagagaagagtagagtgcacaagggcttaaaagccagcttcaattaccagctcaaggtggcagccagagttatttagttgctttaaaggcaaccaacgcacagtgggtaggggcgagattggtagaattatttagaagtctggggttgtaatccaggcctatatgggataaaagcctgaactagttaaaagttagggggctggcttctgagcgtaacattttatttccctttttttctggtaagaacagatactacacttgatcttagtcaaaaggctgagagctccttccagcaagttctgcaaggtccatcagaaccactagacagttactgacactgatgccatccctgctcacaggatagatgttacagatttttttttaaactagaacttttaattggaggatcttgaattttagcagttttaagaataaccgtttaattttttctctcagaattttgtacactggttcatcttaaaacatttttccaaagaggtactcaaatatgtcatttacctataagccatcatgccatcacttagttaagactgtttttactgtttcaagaatttgatttatccttccttttgtcttactgtaggaaaagaatgcctcagccagatgaggaatactgtcttgtgtaaatatattcaaggaaaacacctccactacctcactgacttcataattggaatgtcacatggtttttttaatcaagatgcagtgaactgagattctgaaactccactgtagtttactttgcctgtaccattaatgccaatgtttttataaatcacttgtacatagtacatatgggaatagttgcatatgggaatttaaaccaacatgtggctgagcctttttttttttaatcttcgtaacatgtttaaaaaaaaacagtgattttaactgcatatttgaacctacaaactggtaaatcttattaacaaaaagaatgtacttaaggccctctttatttatagtgtcgagttatttttgaattttgcttaaaatctatttttcatatgaaaataaaagataacaatcaacttgggtctgtcctctgactttacacttcacaggtcattctatggaaaagccgtcaaatttttaccttattccaagtaagtaatctttcaggtggttttcttttacctggaggctgaagtacattatacttatcaatgaagatttcatcatttggaaatacatcaattataaaactattatgcttcagatgcctttccttagccaacatattctttggtggaaaatcaggaaaactttgtaccttggagaatgtgacccagtgataaattcaaattgtgttgcctttcagattttgaactaccataattaacagctcaactccatgatgtatacatttctttaaaaactagaatagcaactgctctcacagtctggcataattattcccaagggggaaatatgtaataagaagttttaaaatattctcgggaactcttttctagatcactactagacagcttttgagtcacaacaggtatgttaccctgttactaataatacagagcagcacagtgcagtcatccctcaccaccaaggtttttattccaaaacagttatttggctagacgtgaaccgttaagatacgggatcaatggagttacaataaagacaatgaaagtgacaatttattaatacacagtaagttctagaaggcatctttcaaaacaaaacttgatttcttttgtatttacattttttgtttcaagtcttagcaaaatgctaaaaggcctggcctagtcacaattactgacatccttctgggacacaattttctgggcctgtgttgaatgaggataaattatcttttctctaaaatgccacatgaaccctctctatattcccacatgaagaggaatggaaggtaattatttggtcttttcttctgtttaggggaatgaactgaaccactcatttttttaaaatcacacttaaaagacacatgggcaaaaaagttccccaaaactactgtcttaccgaatttgagaagggaggtaatgtatgaagcttaacagctggcttcaaaagacacctttccaaagaaattgtactacctctattaacgtgtaaaccaccaaccaaaaaaaaataataagttactccatcaaacacgttattatccataaaaaagacttcaacattgtactggaagatctatttaagcataaatagtactaagcaccaattactaatctgaaggcctcctcacaggtccaagggcaatgagcaacctcaagaggcaggtgactgcacaagcagtaagctatggattaaaaattaaaaggatttcacattctttccaaagtgtactgcccggtgtctggcacacgcatgttacaatatgacaatctgctctatttgtgagcacctgagtgtattacaggggattacacatgcatatgatagaatctggctcccggtacagtcaaaggagaacagcatcagccaccaaatgtgctgatcttacactgaaaagggttgactgaaaacatttcaagggtaatgtaaacacaagaataaagctgtgggtctattacttagtgatgtggttttatatgctacatacgtagacctctctttatacaatgaatatggacagtgctgcaataaaaactgatgacacgtcaaattgttcacctgaagaaaaaccctattatagttcagaaaataatgcaaccaattttaatttaatctagatacaggtactttatttacaaatatttagattaatagcattttgttacatcaaatgaagagtacagcagtctgaataaatccttcagtcacaaaaacaataaaacccactgtaactaactttgggagtcagggtattgcacctcaacaagccgcagtctttagtttgtgattgctaccttatatcccaatgggtggtttgtttgttttgtttttgtaaatatacacacacaccagcaggtcatggtccctgggtgagtcccttgtgatgcaacagtgtaagcaaaatggatcactgtaagtctttaacagaatataccaatctactccagaaatcttattttttaaaaagttaaacaaagacaaaaataaaaatgaatccacaaattaaccaaagcctactttctgcacattccagttttggcttttatttaacattgactatacaatactctggtactaccacatgtttacaacccagaaagatgtacttttatgttagtgtctgtaaagagggatttaaaatgtgtattttaaacacagcagttgagctgagtgcattttctatagtacgctgaggtgttacctattctatttcaaataaattctcaattcccagccactgaatcataaatgcaataaaaaaaatcaacagaaatgaagaacttaataaaacatgttgtccaaaaaaataagattgtttctcttgctatacagtattaattcagtggccaaaccacctggtgcaaagtaataacttactttgtatcagcacaagcgctgaaacacctttagaaacactttcccttttacaaaacaatttatgccaacatgacataaaacagcccctcacactgtgaacacagggatatcttaagttatttcactgtagggttaaaaatgcacaatttaaaatcccttaacagcagacctgtggttctgactgtccagttcagaatctgaccattccaagaagataaaggtataaaagcttaaaatgtgcaatagtaaacccagccttttttctttttctatacagtaaggcaagaatgcagcctgtaatgcaaaaacgtttacaaaaagagaaaagcaggttagcacattgtcgattgcacaagaacagttaagaaaatcagcaggtaagcaacagtgcaaagatggaacagaatctgctagtgttaatcctctgatgctaggagctctttccagcataatgtccccaaacactgccagcaccaaggggtggagccagtactacttgtgaactgcagttgtgtctatttctttgtgtgaaatggaagggagtaacatggtcacatataggtcatactgtacaaactggtattttatactgttccaatgccagtaatcaatttattttcttcattaaaataatatacacagaatgtattgttagttcgattccttcaaattttatacatatttactttctgttaaagagaaaaggataaaatggtataaaaaaagataaagctattaattaagcacgagagagaagataaatggatattttccctgtgtgaggctaagacagaagcaaatctcgttaagaaaaatgccacccacacaacaggaaatttatccaaaacaaaacaaaagcagttatagaaccccttctctaccatcagaagtaatttcacagcaataaacttattggttacaacagacatacttgaacagttaaggatgggaagaaaggcttaagatatcaccaaattaaaccgtacagtgagacaaagccttgccaaagggagggtaaaaatcatgaagtccagcatcagtgctcggtttaaatcatatattggtgacatacttatcacgaggacaagggggaaaaaaagtctagatttaccatgcaggagagatttattactctacttgcctttgataacctgattacatctagttgtttagcagtttagtattgtgttaaactgtttttacaacagagttttttctttttttttaattaaacccagtaagatgtacagaagacaatgaggcagtaaaaagtactgcttccaacagacagaggtgaaaggtcaaatgaggggccacagcaaagaggtcactagcagccacagccttctctctggggttggggttcactggttagccggcctccctgcggggctgaaggtttgtgttgtacaccagactcagcagcattcagatccaagcttccatcctgaatgttctgatagattttcttggcagcctcaaggaaggcatcttctacattctctcccctaagaggcaattgataactttattggagaaccacagttttctacaaaagacaagacactgaccttttgctaatctttagttaactgccatgatgtctccaacttaaccactgtcatctaataagagattaccagaacactgagctaagagaacatggaaaactattttccttttttttttttttttttttttgagacagagactcactctgtcaccaggctggagtgcagtggcccgatctcagctcactgcaacctccacctcccaagttcaagcgattctcctgcttcagcctcccgagtagctgggactacaggagcacaccaccacgcccagctaatttttgtatttttagtaaagacagggtttcaccatgttggccagggtggtctcgatctcctgacctcgtgatccgcctgccttggcttcccaaagtgctgggattacaggtatgagccaccacacccggccggaaaactactttctatggaaagcatacatacatacgtgtactgaaagccctttctacaaaccctatttggacaactacatgtgttatatgcaatcattaaaatactgtatgttaatacacaccatgacaattcagataggtcatttctgtgataacagagaggatactccaaacagaaatgaaatctctctgaacatgctgaaaaaaattccaagaataatatggtctgctcagccaagcatgaactgagctgtttttaatcgggtaatggtgacataatcatgcttagccacgttaacacctccattcagttttctttggactaatagcacagctgagactaaacgaaaacaggttagcctctcctcaccacaagaaatttttggcctaataaatgaagaacaatgatgggtgtaccacagttcaatagcagacatggaagaacaattagaaaatgttcactatgcttctgagtagacactattcccttaaatcatgctttttaatgtgatcagaagtattacaggaagaacagattgaccaagcttgtctgagatgccaaactcaacctcacttgtgaaaagtcaaacactgtcatttgggaaaagtcaaacacttttgaaatgtaaacaaagtttcatttattaacctgggttaccaacaggcataatcaaggtacaatcttttaagtaacaaaaattcatattattttgaaatgtaaaaaaggaagcaaagagatgtttgctgttcttcctgcagtaagcattacacatttatagatagtactttatatgtgtatatacattatatacttttcatatatacggttctactttgagaaacttgaatataattgaaatatctgtattttggtcacacttacgtttttgcactcgcttcgaggaacaataagcctaaaaataaaattcagactataattaggacacttcaaactaactcacaagtgcacttctttagtaacatctgaaaaagtttcccatcagtttttagtactcctcccatagtattttatgaaaaagtatgtaagtttgaggtggagagcatctttatatttgtcactaaataactgtactgctccaacataaatcacacagaaatagaaacacattgttacttcctcattcttgagatttctgagtctgcatttaaaaaaaaaatgcaaaaaaaaaccaacaaaactgtcaagcccacctttccttaaaaattctcccaattgtgaccattaagtcttaaagaaactcaccattttcttcagcaaactgtttggcttcttcatatgtaacatctctctgtgcctccaaatctgctttatttcctatgagaattattacctaatttgtgatcaaaagaaagacaccttgtaacaaaagcagtaatttaaaccaaccatgcaaattctgaaatccaaaaatcttgatagaaaaaatgactgggcctaaaaagaaaaccaagtactagcaattatccactagacagggctacagattcatgaagtcattactacaaaggaccttagcaatgatctaggtcaggggttgacaaactttctgtaaagaataaatactatattcttcaggtttgtgggcctcatatggtctctgttacatgttcgttgctgggtttttttgttgttgtttttaacaaccctttaaaaatttaaaaatcatccttagttcacaagccagtcaaaaacaggctgtgggctgaatgtggcccacaggccatacatactttggtgacacctggtctagtccaaagattacgatatagctgagtaagattactaagggttcatggacaagctccaggggatctgtaaataccttgaaatactgtaaatactgtaattgtgggcattccctagaggagaagattcatggcttccatcaggttttcaaacagttctgagatcctcaaaaagtttgaaagccactaggttcaactcctttaggctatcagtaaggaaactgaagctcaaataaggcaaaaggacttgctgaaggtcactcagtgagtcagtggtaggaggacattagatctcaggtagaaacccaaactgagatcttgagacaaatactatcctaccccacactatccctagaaaggattgagtttatagttaacagtaactgataagagatgtctatgtgtatacacaaggggcagctgggagtaggggtttgggggcacgtatgcagtaagttcaaatccaaggcaaaatatcacccaccaacctatatccaccttggaaccattcatacaagtgaagttaggccaaagttaaaggcagctctgcaaagttgtaagaaaaaaatatgtacccttgggaaacagcaaagggctttggcctttacctggggtggggaggggggttatggataaactgtctttgtacatttatgagcttatttgacaccaactggtaaaatccttccctttttcccccttccaaacagatatggtaatctagatatgaacactttaggaatggatggtttcaactaaaaggcacttcagccattaactttttttcatgtaaaattacagctcctggctcttccactttcaaaaatgtgtgtccataaaccaaataatcatttttatctgaatgtaaacctcatgcaaggacagttaagtagtacaacaaaagtgagcattctttaaacagtgtggacaaagtgcccactgtgaaggggaagaaactttcatatactatccattagtattttaaaagaataaaataatgatacttaaaaaggaaatcaatttataaaaaatcaagtctggtaaagccacaatgactagcatagggccattacaagataggtactcaaaacaagaaatactgccctgctcctgattccctatgaatctccaaataaggcttcttatctccctgaaagggaagacataaagtggcatgctaattacagagatacaaaacatgcccacaacaaaatggtagagaacacaacttctacacagaaatcaagggcaattctatagaaaatggagcacttaagaaaaactcaagaaattttttttctcctgatctggttctatttcaaagcacataaatgaggcaggaaggacacagggcggtaaggttaattttattatactcctccacgggccctctacaatgagttttgtttttaatattttacttgaaatagctatagagtcacagagacttacaaaaaataacagtgaggtcctgtgtacccttcaccaaacttccctaatggtaggatgttatgtaactataatacactctcaaaaccaggaaactgacattggtacaatctgcagcccttattcagatttcagtttttacacattctcaggcacatgtgcgttcgtgcatgggtggttctatgtaattttatctcaggtgcagatctccatcatcactatcaggatacagaactgttctatcactacaaagaaactgcttctgtgctgccctctatgtcatcacaccactaccaccctccaccccctttgctaatccctggcaatcactaatctactccccatctctacaattttgtcattttgagaatgttttctaaatgaaatcatacagtatgtaaacttttgagattggcttttttactgggtatgatgcccttgagaaccagctcaactgctgcatatataaagaattcattcctacgtacggcttagtagtactccactatagagatgttccgaactgtttaaccattcacctgtcaatggccaggttgggaaacacctaggtttccagttctgggctactggaaataaagctgctatgaacacccatctataggtgtgtatgtaaaccttgggtttaatgcgataatggaaatgaaagtttcaggcacagtccctagcatgataggcaaacaatgttaactgactctcaatatgattaaaccaccatttcctgataaaagctcatcttaccactgataacacagttcttgaaggaggcctctaccaaatgttgggggtataaagccaagtgagacacaagccttgttcctgagaaactcaagtcacagctcagtgtgtctttcctcacattgttcctggcataccctcaacaatatctactgaaacttcactcacccctcaaggaccagctcaaacaccactcctctgtaaagctgctttctctccagacggcactgatcatcctaggctctccagcactgtgccagtccctctatttctaattcgtgcttcaatctactttgcagcacagttatctgcatatctgctggttctctccctgctagactataagctctttgggaccaaggatccatgtttatctttgtatactgcagagtctagcatggtggctagcctttaaaatctcaataaatatcatctcagtctggttaagaagctaatgttttaacacatatagaatcctttttatttttgactgaaatttttatccttaattctcctcctgtagttgaaatttttattgaggtaacgcagattcacatgcagttgtaaaaaacagtacagaaagatctcttctacgttttgcccagtatcctccaatgctaaagttttatgaaattaatgcagatcccttttaaaatcataatttcagatttcatagtcttcacatgagatcaccactacattcataatagtaatgacaaacatgaacaaaaaacctaggtataataaaatgcaaaacctggtttaataagaactgaaaaataactgttaggttttcttcaactaattgaagaatacaataaaaattctctcattcttagtacctgaagacaaaaatctcaccagtaaatggcttccctttttgggttagcttagttcttaaattttctgtgtaataagatgccatttaacttacagtatttggattggtgagattccttgcatctgtcaaccagctgcttaagtggttatatgtacttcttctgcaaaaataaaagtttaaatttgtgactgccatataattatagaaaaaaaacttaaatatttaaaatacatatttaatcaacatatcctaaaataataattttgctttgaccagttactcagaacagtagttgtgaaatacaactgcatacttttcaaaaatctagccaaacctaatatttttaaataaacaactcaatatccaacaactttgataattacaggtcaggagtaaattgtttactcctaaaagcataccgtaaacagaccaataagcaagcaaggaacaacacagtaaattgatggaaatgccaatgtggagtcaaaactcaaattactttgaaatcatacagactttcaatcacaaagcacaaagttgtatcaaaatgcctaaacatgacacatttaatggaagacacttttgcttgtctttaaattttaatttcattaaaaaccaagtcacactattataagctggcatacaattcacctttccttaataatttaaagagcaagctaactataacagcataaaattgactttgaagacatttgacaagaattcaagtccccagatatcagtgaaaa

SEQ ID NO: 80 - DNA, 147868 bp, Homo sapiens
tcctgcatcacagaaaactcccttaaccagttctttcaggaaagggagtttttctagttagattaactgattctgaacatcacaacaactttattcccttttccaggcactaggaactcaaaacttttaagaatgaacttggtcctgagactaaaactggtctggattatttacctgatctctgaaccagatgccaaacacaagggggaaaagtaatctcttacattaaaaatatttaaagattattaacttcttaacttgaattcttccgactcttctaatcaatttttaattcttctaaattctttccccattcaaacctgggtaaaagtaatcacttagtcaccttcaaattactgtctcttctgtgctcttctcccttgattttcctaatttctttccctcttctaactaaaggttgtagctgtacatactttgctccttctattttatgttaaagctatgacttctaacaatcccaaatttctacttcaaatgctttaaagactatcataaaattgtgacccaattttagttgtactaatttgtgtacctgctaattatcatacattcattaaatgtgagataactaattttgaaaatgtatcttaaaattacaaacattcatatagtagaaactatttccaaataaaagaaatgatcactatttcggatttaataccagggctctgtctcaccacaccacacatttttcttgctcgtttctttaaaaattacaaataaaaaccataaaagcagaattaaaggaaaactactcaaacttactaatttcagtaaacaaaggcagaaaacatttaacactgtagccaccaacactcacaacaggtcttccctttcttattctaagaagatactgtctagatttaaatatattcccatagttgactgatattaatacatttcagtcaaaagtatttgcagtagaattatattcaatactaaataggcttaatgttgctttaacaaaagatttctcagtctcatttcttgaacatgaaacatactattgttaaggtgaggaatatatttttacctaactttggaagggaaaaaattcttcccctattatttaacagtacttttgctttacttagagaactcttgagtctaaaaaaaaggacaggaaatgctggtctggttcaaactctgaaaacatgagcccacttaacattacaatccccataaatgaaaaaaaaaatcctggtaatattctataacttgtatacaactaccgggacaattaaaattcactttattccacattttacagaaagtattcgaatcaagttcatatgtaagtaaaagatctttattgcctttaaaggaaaaaaagtaccacatatttagacaacaggcatttaacacataatcaacaatttgcaaactaataagaaatacaattgtgagttactatttattgggtacttgacatatgccgggcaatgtgctaaatattttacatacaatttcatttaatccttactactatcctataacatagttaattattatcctcattttacagatgaggacacagactcaagaggtaacatgcccaggtcacacagccaagtctgtactgaacctaggactgttttaactacagagatcccctcttaaccaccacaccatcctgccctctccaccgtcgtgcctcctccacatggttatcagctgtaccatgtagctctgcagtattcactcgcttaattataatttaatattctgaataagatacatgaattacattcagaggatgcactgcagtcagaatttatagatataaatgactggtaatactagtaatactaacttataatactataattcatttacttagaaaaagtttcttgagaacacttgagagtaaaccatgtaatgatctatactactttttataattcttacttaattctcacaactctgcagagtcattatcattatgtccatgcaaaaaattaaagaaactgaggtttggagaaattcactcatttggccaatgttataaagtttgtaaatggtagacctagaacttgaacccaggcctgattccaaagaccatgattttctctaaggtattattagcttatttcaggtatgtacaggtagactgataaaataaaaatcagagaaagaggaaggatattagtgcatgtaaaatttagctataaactacccttgctgccaagagaaatatttactaaatgcatagtaaacactaacaactgtgccatgtattcaactgactccttaaaaatattaatatgcttaatattgctttaataaaggatttctcaacctcatctcctgaacatgaaacataccagttttcaccactggggaaacataccatttcaccactgtgaaaatataccatttttcaccaccattttcaccactgttaaggtgaaaaatgtattttaaaatggggtacgccatcttgtaaaattctgcatatttcttttactcaacaaaatgatagacacattttcatgtcagtacatttagatctaagtggttactgaacaaatattaaacactaattattgttgtgacaaaaatagaatgcatggtttctatttactgaatcagacacctttctaagattacacagacatataaacgactagttttgaaacatgtaggtacagatgtgaaggtatacactttcatacatactgcttgtggaaatgtgccaacattttggaaagtaatcagtatgtttaaaaatcttaacaataatccaaatcatcctttggcccagaaagtatcctacatatacaaaagcttcagcccataaggctacaggtattagtgcatttaatgcaccatttttacagcaaaaaactggaaataatcagcaaagaaatgactgaataaagtacatctataatacaaaataatatccatgtagtttagaaaccattttgattgatatgcattaacctggaaatacatccatgattttgttaagtgaaaaaacacatgttgcagagttttatgcaacagcataccccactttcaaacacacacacacacacacacacactcaaccctatattcatataatatggaatacacaccaaattgtgaaaaatacatggacaggagaaacagggaatagagaaattattaacttttctttatatatccctgcactgacttactataatgaattaaaaataaaattttctctaccgataaatatttcaaaagcccttttctattttaatacaggttaaagaatacccaaacaaaaacaaacaaatctcccactcataatattcccaacattatttccgcatttactgataataagaggaatatcttatgaagccaataatacgattgggttcaaaatagaaaaaccaacactcaatagtagagggcatatttttgggagttttttaatagcttaactacttactgtttgctctgattttaaaaactgttatacagctattctactccttagaacctatgatgttactgtataatttttacatagctgatccaagacataacaagggaaaagcaacccattaaatattccaggtaatttaattcttatccttgttatttccactgataagttttttgtttgttttttaacatgcacgacgttttgttaaaaataccagagctgagatggactgcttctgtagttccaacataaacatatctgttaagtatctactaagcacaaagcattgtgccaggctttagcaagacagcaatgatcaaaaaagacaacactgtctctgccttcgtggaactcaacaacagaagcatgctgacttgctttagaggcccactaaaatggaccactactacctgatttgtcagtcaggcggataaaacttctgtagttaatctaataatctaatctaataaaaatgagtggtcaatttcctcaacagtagtacaagtagcccacccacttaaaaaaaaaaccttacttttgacaatatacttaatgtcacttttatataaataatgtgaatcatttttaaaagctggattgcttaatgtggcaaaagtaactttgatggtcttctatatacaggaaataaagtattctaatactggacctctgtttacagaaagaaagcacttaacaaccaaaaagccaaaaaaaacccctgcacttactgctcaagttaaaaggattaatagtgaaaattttactaccgatattgtgtctgagatttgcttcaaaataatttggcaaggaggaggcaagtgtatattgatgaagcaagactgatcactgttgacactggctgataggtatatgaatgctcagtatgctacctgattttgtatatatttaaaattgtctagaataagaagctttttaaaagtcaagtacagtacctctaatacttctatttgtcaaactgttgtctttagccatgcctggcattttttaccacataaaaatgtttcaagcctcttttaaaaaacatgaaacatctctcaatagcccaagttttcacattttatttaccttaatcaagtttcctccactagcacaatatcttactgtgactatgcaaagatatttgatattgataaaaatgaacactccaaattctgttgcaaagttgaagtatgcaacaatgataaagtttaactgtaatacaaaaaaagcaacaactttttaagatgtagctttaatttcaagggattttttaatagctattataatctaaggttttacgtctttacaataactgccatttattgagggcctaacacatgccagctactttataaacagtctctaatcctaaaaactcatttttcagataaggaaaccgaagtgatctacccgtggtcatactactactaaatggagagctagaattaaggcccaggtttaactctacatgtagctctccaaagctatactcctctctcattcattcaaaagatattaaacacccactatgtgcctggcactgttacaggcactgatttactatatgccaagcaatgtgctaagggctttctttaaaccccatttaatcctagcaacaactctaagatgcaggtccaattatcccctttatagataaggacactgagtccgaaaggttaagtaacttgcttaagatcacttaactaggaagtggcagtactggagggagaacccttgacagtatgactccaaaactcttaaccacgacatacctctaggcatgatcaaataaaactgcctaaacagaacttggaagaaaaaatttggaaaggcttgggggaataaaggggtaggagctggattactgcaaggtcaagtttgtcttcaacaatcaaatctaaataaaaggcagttgttcctctacaatatttaccttagaaaaataaaagaattttttaaaggcagttgggatagtaacgaaatgagcagtaaactttgcaagagttcaaatctgggctctgacacttgctgtggggtcaccaggaaggcacctgtcctcttggaacccgtttcttcttcatatatgaaactgaaatcctggcatctctcctttggggtttgtaagcatgaggatttgccagtgtagtggttgactttatggactttaggtcataaaagggtaatcagctgtcatccaatgcgaacacagtaaaaaaggaataaagttgtaactacattataaatggtcatgtctgtaaccctagcctaatttttgaatgtagtacagaaaccaccagccacagtgtgagccgaagccagtttgtaatgtaccatcaacagccagacacacatcacaactttaggcctcagtttcctcacttatgaagtggagacaacttatctccgagggctacgcggggcaagataaataggtacaaaaatacataaatatgtacctggcccacagttaaaacgcttaaaacactccagctctgtcgtcttctcttagattctagaaatgccacaactttctcttatttctagatgctctgtaggttcagggccgtagaggctgtccacgggcctcacaggaacgcaccaaaaccaggacatcgcaagcacaggcgcacagacccagaccccggccccggcccggcccggctgcagggccgggctccccacatcgacaaggacaccggagctgccccgagacgccaagagggctgcgaagagctgcctttgtactcagagccagacgcggcctacgggacgggaccgccacgtctggggcttgcgggctgcagggcggcgcggcacgcgtgggtacaccctgcgggggcgggctgcggccgcggggaacagcggcgagaggggggcccgcgggagatgcggtcctgcccagccgcgccgagaaggcggggaaggcgaggccggaacacacccttccctgcacgcctcggagcgccccgccggttggggagggcaggaggctcaggccggagccgcgcaggggacacctccgcccccgcccaggagtcctgtcaggccggcgccgcggcgctcaccgccgacccacgggctagccacggcctgacggggcctggccccggggcgccgcccgcctgcggcccagtctccaccgtccccacacacgcccctctgaagaacccggcgcgaggaggtatcagccggccggacactacggaaggcccgggttacctggggggttgctggtggctgggcagctttccgggcgggaggggggcgtcaggaccaggaacaggagtgcggacgcagcgggagagggggcgggggcggtcgaccgaggcgccggcaggtacactggcaggccgagaggtgcagacgcgccggcagcagtagcggcagtagcagtggcagcggtgactgctcctgtgctccctcagtatcttcctcgggctggtccaagatggcggcgctccctgcacagggtttcctgtcaccctcgcaatgggccggaccacaaaagaagggggagaagatgcgcgcgcagctggcggagcccggaagagggtggctgaggccagcccgctagccacgccccttcctcagccctcacctctggacttgtcgcgccgccgctgaggcccgccccacgggcgctcgcgcccggagggaaggtggaaagcgcgtatgcgcaagcgcagtcgcgtgtcctcgcctcttgggggagctactgcgcaggtctgcgtggaacctggtggggtgcgcctgcgtcttggagaactagggttgtcgctcgtggagacttttgaacaatttttaaagccaacatttaccacttattggacgcttaccgtatactggccaccatgctaagcatgcatttactgcattcattcaacgtgtatttatgggggcatttactgtatataccgctgtatgcttcgtatataccggtcctgtccaacaaacgtcggaggcacgcatccccattgtatccatggagaaactgaggctcaggttggtcaactctcttgtccaagatcacgcagctaggaagtgaccctgcatttcatctctattttgacttcactttggggttgcctttgacagggtgagagaaatgtgatatttttcacaatttgtctaccacctgccatcttccaacttgctctgccataatcactgccccagaaggtttcgtgcttttcgggtgcagggacacgttttgactttcttggaccctgagcacttttgccttgtggcttgtacattacacacacacatatatttcacacacatgtaagttaaatatatgtataaatatttaacatattttacaactgcattgatataaacatgacgtatcaatattatataacaaaatattttctctgacctgaaagttcatttttttcttctgactttaaaagaatgtaagccggccgggcgcggtggctcacgcctgtaatcccagcactttgggaggccacgacgggcggatcacgaggtcaggagatcgagaccatcttggctaacacggtgaaaccccgtctctactaaaaatacaaaaaaattagccgggcgtggtggcgggcgcctgtagtcccagctactcgggaggctgaggcaagagaacggcgtgaacccgggaggcggagcttgcagtgagccgagatcgcgccactgcgctccagcctgggcaacagagcgagactgtctcaaaaaaaaaaaaaaaaggaacgtaagcaaggagggctggtagtctgcgcctgtaatcctagctactggggaggctgaggagagaggatcgcttgagcccaggagttctgggctgtagtgcactgtgtcactagatagagtgtctgcacttaagttcaggagggagggaccacccaggttgcctaaggagggatgaaccggcccaggtcggagatggagcaggtcaaaactcccgtgctgatcagtaatgggatcatacctgtgaacagccactgcactccagcctgggcaacatggggagaccctgtctctaaaataaataaatattcatttttgttggcccctaaaagtattggaggccctaagccctgtgcatactgtactgtgcctaatggataaggtggccctgccttagttccccacccccaaattaaatcaatctttctcttagcgttcaggaccttttatgaactggttctgccatgaacaagtgagatttcactgtaaaagtgtgtgccagtttgtacatctcatattttcagagacctgggttcgaattcctgctctataatctaatggtatgcagttgtgcatgtcacttgatttctgagattgtcagtcttttctgcaatatgaaaatagtaatatctctctcaaataggtctttgtgaaaattaaatgggatagtatatgcaaaatatctggtatataataagaaatggaaatgattattacatgataatctaatctaaggtgatattgaaatccttttgcaaccctagaggtctaggcttctatttccacattctttaataagtatagtttgttgtcacactttaacatttttgaaactaagaaatttgcctgtgccaagtaaaggagaaaactgtgaaccaatgatcattaattgcccaggtatgaacttagacctggctagtaagtttccttatagccattatcacctgaagggagatctttatgtatagctgatgtttattcaacacttactatgtaccagcaactgtcctaagaatcatgcatattttctcatttaatccttaccacatccgcatgaagtcagtactatatttaccccattttatgaatgaaaaaactgagtgtcatacagatctaaagtcgtttaggtgaaaattgggtgggacttaaatctggcaacatgtgacctcagggctgtactaagccctattccatttcctcccttatttgctcttgtttcacaatagccagcttaaatgcaggtccctaactgctgctttcctatgtgaaagacattacactttgatgcagctttgaacagaaacactcttgtggatgcagagtgcctatcacatgctaaggaatgcaattaaaaaacagtaggaatggtcaattcttttaataagtcccagaattttcaaagtgaggagagtgtatgtgaccagttgcagcataattaagagggactgtccattgggtgccaaacatccattggggtttctacttaacttttttaaaaagttgtttctataagaagagatgtatacatggaatagtcactgcagcactgtttgtaataacaaaaaactagagacaaactaaatgtctatcactagaaagctgtaatagtaaattatagtacatctatattgtgaaatactatgcagccatcaaaaagaatgaggcccatgtatatgtcctgatatggaacaatgtctaggaaatacttggagggaaaaaagcaaggtgcagaaaactaaatagtatgccaacatttgttaaactataagaggagggcaaagaagacatgtatgtttatgtaactagacattgagaggggtttattccatgtatacatctcttcctattgtcctggatctgttgctgaagcccaaacttgaaaataaaaagcccacaaggagctcacattctacactgaaaaaactgccagtggctggggccagctaccttctagcagggaatttgaagagcagttgttgaagaagtcagctcttgaccaacttctacctccactccactactccctcacctattccccatttccaaccccatccccacagacacaccatcaccagtaatctgtggaaagaaagattggagacatgggagggaagtcagcctttagggaaattgtaatgtcatggaaagagacgccttctttctgtcccctcatggagactgtgtcctcatctagaaccaaaggagaggggctccaaaagaatcaccagtgaggattgggtgtgcctgcaggaagatgggactgacaactccctggatatctatctgtttgggcagcactgatctgctctgccctattgcttcctgcacaaaggagaacacagatggagagagacagcactggaggggctttggatggtgtggggagaaccttagatgaagaggggctgaagttgcttccccttatcccttcctcccaccttgactttctagtcccagattggagtacggcaaagaagtgtccatcagagaggagtgtggcataatgacacaagctaaccatctgctggaagatatagcaaatgtgtgaggggtcacctgttcctgggaagatgcctggaatcctccaggtgtgcaggttgtttgtcacctgctctggcttcatttctgcttgtatttttataaattgttttgtaaaaagtagatgttattttatccttcatctcttcccagagcctaaacaattaaagtcattttcagatctctctgttgtgtttatttaaacaaaattaattcatctcctcattataggcttaattttatttgttcattttcctcttatgcttgtgaattttggttcataggcttatcttgaattggagattcccccctacccctatgcttgaatcttttttgtttagtggttttggagttgccaccgagccacactcagactttaaaatactggtgtcccaattcctgaagcagtattgaagatttagaagaactaatacaatttgtactctaaattttattaccacatgtgtgttctacctaatttaaaaaacgaatatattttaatgtagttgattaacttccagtgatacataatttaattaaaaagaaatggtcaaaaaagctagtttaaccaaaaaaagttgagatcaggtgcggtcatggtggtatggctgtcgacattaaccaaaacagaaacagcaattaatatacttcaaaatttagtaggttgacaaagaaatcaaaatcaagggcatgagactcattcgtctctgggtatgaaaaaggattagattcaacttatcacactaaaaaaaggtgatgcataaatgtaacaataagtacattctgtattcaattgtaaaagaaattgtgtgtccattgaaatagtgccctttcatctccccatacaccttataccaccccctcccaaaaaatatcctctcgtgtcacagcttatgagggcatgacattaatgaggtaaaaagcaagcttgaaattttcccaggaaagcaccctaccggagactcatttattgtcattgaagcattcctttggctgacgaccagaagttggtggtttcgacttaagaggccatgttacatgaaaaaaaaaaaagaatgcatctttgaactttgtttgtttgtttgtttgtttcgagactaagtctggctctgtcacccaggctggagtgcagtgatcttggctcactgcaacctccacctcccaggcgcaggccaccctcccacctcagcctgggaccacaggcatgtgccaccatgcttggtaaacatctttcaactttagattcacactcagtggggcataatgaccacaccgtgagatccacatggaaactgagacctactgagaaaacatttaactctttcattgcatgctcactccaaggcatgcacttattcagaaaaagggaagggagattgatatctaaattatttctttattgctttttctgactttgtacatttagttgaaataatgcgagttaaaagcatgtgtgatgtaacacaactgaattaaagtgatgatgaaggtgctgttgagaactgagattttactctacttgcaagctaacaagccagcctgccagtttcatggatacaggcagaagatgtgagacttctgagtcaaagacagaggtctgtattattcacagcacagcaagcagcatgagcatcagcatatgtgcatcagttctctttgtgccaaagacccatgggcagtgatatgaaggggtaccagcacacacagtggattgtattacagaagaaccctgagcttagggaaatcacatattttataatgggaagtaattatatctatttttgctgtagagggaaacactatctctatcctccaagcctgccctacaaacatccttgaaaagacagtctaggacaaagggcagtcagtgcctatgctcacaaaatgtacagaaacatgagacccatggaaggtcatctcccaacaggggcaggattttttgtattgtagaatatagtactgtatttggtggagggagttaatgagtaaatggtatgctatggaggaaagtatatggttttgagactcaaactgacttcagtttcatttcctgtgaccttagacaaatcacttaacttctctcttttttttttttcttcctgtctcacttggtcacacaggctggagtgcaatggcacgatatcagctcactgaagcctccacctcctgggctcaagcactcctcccacctcagccccccaggtagctgagactacaggtacgtaccaccacatctggctaatatgtgtgtgtgtgtgtgtgtgtgtgtgtgtgtgtgtgtattttttgtagagacagagtttcttgatgttgtccagattggtcttgaactcttgagctcaagggatccacccaccttggcctcccaaagtgctgggattacaggcataagccactgtgcctggcccaaatcacttaacttctctgagcctcaactataaaatcagataatagattttcccctcacccatacacacacggaattgttgttcagattaactgggaaagtgtaactgaaagtatgtggtacagtatctagaatattccacgcattcaacaaatgcctggtccttctcttctctcctacctttattcactgattccctcatccatgtgaatcaggcacacacttaggttcctgccagagccctgaaccccttccccagttggaaagcacttcttgagtacctgcttagaatacatgggttcagatgctgcaaacaagagactaaagaatgatagtggctttcacaagatagaaatgtattcttcccgcacatggaagtctgggtaagtagtacagaggtgatatagcagcttgaaggcagcaagatgtaagttcctccttggttatggcactgccacccccaaatcatgcttctatatcatggctcaaaatacttactccagctaacaccaggagaggggagaaaaagaagtagatagcacatgccttcctgttaagtgtatgacccagaagttgtacctattgcttttgctgacatcccattggtaggtcacatggtcacacctagctgaaagggatgcagagaaatttagtctttgttctggggaggattattactaatgagggaagaaaagaatggatactgagaaacaaccagctatttttgccataccatccttcattgcctaaaaggggggcaggtgttagagcaccttgaaggtccagggaggctgatgttaaaccctgaggccaccaaggtgaggacagggaccatcagtggaccatgaaatctttcccaccagtgcagttcccttaggatgcccatttggggctctatgcaggactctgaataaatagcattcctttgcctcgtctgacttctgaacaagttgagatatcaacaaaaagatgcagaggaaggccagaatattttctttattagtgatattgccaggttggagaagaaacttttagggttggtagctgaagggtgccactaatagtgaaccccagaagtgggctgcaaagactagggcaggcctcctgctgaagggagcagggctgaggagcagctccctccctatcagaagaagtgctgagttgggcatgaccaggtattctcaaatgtacaatccttcatccttccaggaatggataaagcacggagaggaaccaagaatgtgctcagaaaaaaatccttcctcactgaaaccaggactaaggaaaggagattcccttctaccatccatggtgagcaaagagtggggcttggaattagcagcggggggtggggaggggggaagaaataccagtggaagcaagcataatagtgcctacaaatacatgagggacccaaactgacaagtcagaaatcatccaacactgtaattggatttcagtcccagccttgcttcttagtagctgtgtggctttggaaagttccttaaggtctctaattcttcatttccttgtctcaaaaatcaggaaacagcagcatttaatacctatgtgaattattaagagaaaatgaagcagagcatgagaagctcttagcatagtgcctggtagggaataaacactcaggaaacagaagctgctagaattatttccaagagccaatacatagctcctgaaagcagtttccccaagtaagttaggaaagaagaaaacctttatctgctatcatagaattcaacagaaatcagaaagttttctttagagtaatacaaataattggagagaagagatgaagaatgagaaacaggcctctctgcatagtatctggaacaatttgggctaggccttcactttctcatattctttgtgccatgaacacacatacacgcacgcatacatgcacaatagaccagtcaagattcatctagaggtgatataataaatccctactctcaggaaaggatattgcctttatagatatattagttaggagaggctaggttttactgtgtaagaaatgactccaaaatctcagcggatttaaaccttatcacaaaggtgtgcttcttgcccactctctatgtccataatgtgtcaactacttccctgttccacaccatcttcactttaggactcaggctgacggagcacgctgcctgtctgtgtctctccgtttctctctctggaacgttgtcagatgtcacggcggagggaaaagagacctggtgagtgacgtgctaagtcttcaagcttctgctccaaagtagcacacatcacttatgctcaaattttcttagccagagcaagtcttatagcctcatattgatagagttggggtgcataattctcctttggggaggtgaatatagctgaatgtaacccagtctaccacagtggactccccaagagccagagagacagccactgagagctgctaatatctggctgatctggggccttctctttgcctcagtttatcctctgtgaaatggagataccagcacccgtcctgtgaaccttacagagaagggctaggaatgcacgtgggatcaccgacatgcatgtggtttggcaactgtaaactaccacacttgcatgagagggtttcaataccagtatgagtgcattggaagggataagaacacattataaaacatttcaccccttctctgcccacaggaatgacttgccgaatttttagcccataaccaggcactgtgtaaaccgctttacctcattcagtctttgcaattataccacaaggtaagtaatgttattaactccactcacagatgtggaaacaactgagtgtccattgaggaatgaatggatgacaaaatgtgatacatgccacatttggggatattgttgataataatgggatgttattcagcctgaaaaaggaaggaaattctgacacatgcgacaacaaggatgaaccattatgctaagtgaatttagcccgtcacaaagagacaaatagtataggattccacttatatgaagtacatagaatagtcaaatacagagacacagaaaattggaaggtggttcccctgggggtagaggaatggggaggtattatttaatgagtacagtttcagtttgggatgatgaaaaagttctgaagatggatagtggtggcggttatacaacaatgtgaatgtacttagtgctattaaatagtacacttaaaagtggctaaaatggtaaattttatattatctatattttaccacataaaaaagcatatgacagcaaaaacaaacaaacaaacaaagctgaaaaaacccacaagtcttaaaatgccttgaaactttgagcaatttggctcacacaacagatcctttagccactatgtaagtaggtgatggcattttagtagctgatactgcttataaatacttccaggtgtaaaagttgctattaataattaattggggatctggctgggataggggtaaggtggataaagcactgaactgggaatgagagcttgaggttaggacttagctgaaaccagcggtgtgaccttggctgggtagcttcccctctctgggcctcaattttcctatctggaatgtagagaggttagttgatcttttcagttcaattttatttttcagaccaaaggaccacagtcttgcagggcagttcaagtagatggggctctatctcctcttccgttctctcccaataaccacctccccaccaaaagaaaaaacccatagcaaaaaaatatattttttgaagggctttatgaattggacttctgttcaaaaactttaaaaacagctggataagggaatctctgagggctctgatactctgtatttgcttactggtgaagctgtgagattaaggagaggccgctgggttaaccatgcattcattcatcaatgactaatgattgagctcaaacctgggctcctgtctcctcctgtccactgaagcccttcagtgaccaccttcccgtttttctgtagagtcccttatatgggccgatggggaagagactatggatgccttttaactgagccctcataatgcgataaaaaaacataacaaaacagatatcccagcagctatacaagcaagcgttttcagagctcacactggaaaccagactctctaatccttatcagttgtttctccaagatttaaattccaactctgcagtttattagctctgagacttgggcaagcatcttaatctctctgggcctcagtttcctcatctgtaaaataggtatggtggtccctagtttattggattgtcgtgaaggttataaatgtgtgtaaaatcccacttcaccgtagccctctatcatttcccaccctcttctctccctgccagggagtcagtgccctcctggaggaggcttacaatacagccttcaaggttgactctgggcattgcttcagtacagattagaaattattttagaatccccagagcatggtatctgcgacaaattaagctagacataattttaaagcattttttatgtttgaaagtcttttggtctcactccttggccttttttttttttttctgagatggagtcttgctctgttgcccaggatggagtgcagtggtgtgatctctactcactgcaacctcctactccctgattcaagcaattctcctgcctcagactcccgagcagctgggactacaggtgcgcaccaccacgcctggctaatttttgtatattttttttagtagagtaggggtttcgccatgttggccaggctggtctcaaacttctgacctcaagtaatccacccacctcggcctcccaaagtgctgggatcacaggcatgagccactgcacctggctcttgctcttgacaaagatctttttcccgtccagagattggagggaaagctaaggagaaaaggcagcgtgaaggaaggagaatttcttcctgcccatatatttattttgaattttacaggtttaatgtctgcctttcctcaccctgagctgagtgggaaaggtaccatttctggtgggttcactgctcgatacccggcctaagtatctacaagttataaaatcagaaacaaaatataattagtctcatcaataaataaacccagggcagctgggcttcacggaggagtgacaaatggctccaagcagtctacattttaggacaatagctggggtcactggcttccaaaaactatggggaaaaccacttccggcttcctgtatcccttcgtctattctggtatcaaaacgacaaatccagaggagccgaatcaggcgtgctccaccagagggcgcagcaggcccatgccaggccctcttgactgccagaactcccagcctgtggctactgctcccatttgtgttgctcaggcacacctggtttggcagcattgtttcctcagtctctttgttagttcctctgtttttccaagccagaagaaagtgaagaagtttgcagtcaggtgggcttggattaaaatcctgactctgccgtcagctgagatcttggcaaattagcattgtgagctgttgtattaatattaattggtgacttcttcccaaggctggggaatcacaaaatcatagactcttggcacaagaaggggcctttgagatcagcccttagagcccccacatgtcatggatggggacactgaggctcaggctagaccagagcccaagtctctcagcacatgggctggggtcctctcagctacacccagctgccttctttccaaaatccataaaacgataaagagcattcatcaatgaatgaatgaatgaaaagattaaaagccctttcaaccgacgagctcgtaccttcttttagagcaaggactttagatccagacaaaagcacagactgctgtatccctcatccagcttcagcaattacttgacctgttcagtctcagtctccttatctgaatggtgcagggcatactatggggatcataaaagcacctacctcacagggtttcgtgaagattcaacgagtgcatgcctaaaatgccagctcaggcacctagaaggcattgagaaaatgctagttctttttttctcccttctctcctcctcctttctttccttccttccttccttccttcctcttcttctttcttccttctttctccttccttctctctctttccttctttttctctctttctctcctcctccttcttcctcttcctcttcttcttcctcttcttccttttcttcttcttccataagccagaaaccaaagggtagatgttagttctacattttaaaatctaggttccataatctttctgagtctcagtgttcttgtctataaagtggagaattttcaaagcattgtgggaggattacatggcacaacatatataataaaacccacaaaacaaggcctggttcatggtagtgtacaaaatatattaataataaatactagtttatcctctttcatgaagtaaggaatgactgtttctaagaacaaagagggataagcctgcattcctaccaattccaaagacttagcagatagcattcccaggaacacatcatttctcctgagttatcctatgtcatattcctacggagctcttgtccaaggtctcacgagctaacccagtttgagaccccaggagctactgcattagttaagttcttatcttttctcttctggacctctgttgtagcatctatgccttagatggatgagcgatgccatctggctggagatgtacctcctggaagtaccttactgggctgcagccactggttaggtcggaatataggctccttgttgtatgagcttcctagggctgctataataaaagtaccatgaactgggtggcttgcaataacaaaaatgtgttctctcacagttctggaggctggaagtccaaaatcaaggtgtcagcacagctgtgctccctctgagactgagtaaatccttccttgcccttgcccaacttctggtggtagccggcaatccttgttgttcttggattctggctgcatcactccaggctgtacctgtcattgtcatatggctgtcttctccctgtgtttgtatctcttctcctcttcttctaagggcaccagtcatattgaattaaggacccccccccccacactcatatatgacccatcttaatttccatctaagttgcatttgcaaagacctcatttccaaaaaagatcagattcaaaggtaccaggggttagaatttcaacatatcatttttttttctttttgtggggcgacacaattcaacccgtaacattggttaaaagatctctaaaacacctgaaaattggccggattggtggctcacacttataatcccagcactttgggaggccgaggtgggtggatcacctgaggtcaggagttcgagaccagcctggccaacatggtaaaaccccatctctactaaaaataccaaaattagccaggtgtggcggcgagtgcctataatcccagctacttgagaggctgaggcagaagaattgcttgaactcaggaggcagaggttgcagtgagccaagatcgcgccactgcactccagcctgagtgacagagtaagactctgtttcaaaaaaaaaaaaacctgaagattttaagagctctccaatttactaatatttataatgtacatgtaaatcaaccaatagaattaacatggttatgttaatttattggaaaattaattataatgtttatgattagaaattatattacaagccatatatttcaagtatcatataaattataattatacctataattgtttgtaatttattaactgttagaatagttaattaattttgaaaaaaatagctgggtgagtgaaacaaaacatttctgtggactgaaaggctcttaggccatcacttttcttatttatttatttatttattatttttttcagctcactgtagcctctgcctcccgggttctaacgattctcctgcttaagcctcccaagtagctgggcttgccagcaggcctggctaatttttgtatttttagtagagacgggtttttgccatgttggccagactggtctcaaactcctgacttcaggtgatccacctgcctcagcctcccaaagttctggaattacagacgtgagccactgcacccggcccatcacttttcaactcctgcctcatggaccatcagagtgatcattctacaaagcaaatccaactatgtcactcccatgcttagtaaccctccatgatggccaacagctatcaagaacagctgacaaatgaaactgccaacaactacctccagctacgtctccaccacttcctgaagcctgtactcagggaaaacattgctgctttaatctgacacaggacagacattcactggccaagactttgcttgctatatttcccccagaaacagtccctaactctcctacctgcctgcttttctctgtttcttatccttcatggcccagctcaaaagccacttcctctgtgatgcctgccaggccttgtaatatcctcctacccccaggttccgtagtaccttgcttctgtattttgcaggacttctccctgttttcttggtattatagtgagattattctattacccacttctcccactaggctaggagttcctggaagacaggaattttaccttggtcattgtattagtttgctaggactgccgtaacaaatagtacaggctcagtggcttaaacaacagaaaattattttattctggaggctacaagtccaagatcaagatgtccaagcgttgcattcttctgagggttggtttcttccttggcttgtggatgactgtcttcttcctgtgtcttcacatggtcttccctctgtttgtgtctgcatcctaatttcctcttctttttttagttctgggttttgtcttccactttatttagatttttaaagtatttttctaacttaaggagatttcttttttaaaattcaactttggctgggcacattggctcacgcctataatcccagcactttgtgaggccaaggcgggtggatcacaaggtcagggtggatcacgagaccagcctggccaacatggtgaaaccctgtttctactaaaaatacaaaaaaaaattagctgggtgtggtggtgggcacctgtaatcccagctactcaggaggctgaggcaggagaatcatttgaacctgggaggcggagattgcagtgagccaagatcgcaccattgcactccagcctgggcaacagggcaaaactccgtctcaaaaaaaaaaaaaataacttttattttaagttcaggagtacctgtgcagatttgttacagaagcaaacttctgtcctgggggtttgttgtacagattattttgtcacccaggtattaagcctagtacccattagttctttttcctgagccactccctcctcccaacctaaaccctccaataggcccctaatctccttttcttataaagataccattcatattggattagggcccaccctagtgacctcattttaatttaattacctcattaaagaccctgtctctaaatacagtcacattctgaggtactgggggttaggacttcaattcaattgggatgtggctgagtggcacaattcagcccacaacagccatttctttaaattttttaaatttaattaaatttttaaatatttcaaataatatagaaatgtattattattattattattattattattattattattataacctcaaacaaaacaagccctcctttctctgctcttttctacccaaccgttaatactgctaccaggtctgtttcaagcttttgcgtatataagggtacatacataaagatataactttggtgtgtgttttctcttttacataagtacgatcaaattgtccatattgttttgcatatcctgatcttattcattctttttatgtatgtgtccagtctacctcatgccctgactcacagtttagctatgactaagcatgttcagaacatttgttgagctcttaagaagggtggtcatggagtataggtctgctatgaattgtctggcagtcatttaatattgtattatattttaggtctgtcaacctgaaataaacagcagagagaccagttctccaaaacaaagagtttatttgagaataacagggaattgcgattttgggtgcacatgctgtggtggaccacaggtgcaccaaaggggatggggcaagaggaagcttttaagagaaaggacgagaggccaggctcggtggctcatgcctgtaatcccagtgctttgggaggctgaggcaggtggatcactggaggtcaggggttcaagaccagcctggccaatatggcaaaaccctgtaactactaaaaatacaaaaatgaaccaggcatcatgacgtgtacccataattgcagctactcaggaggctgagtcacgagaatcacttgaactcgggaggcggaggttgcagtaagccgataacgcaccactgcactccagcctaggtaacagagtgagtctctgtctcaaaaaaaataaagaaaggaggaaacgtacatgtaagctaatttgaaaaaaagaccattggttacaggagcttgttgcaggagttggcattagcttattggtggagacagccactgttggacaaatgtccctgtgcaagccaggtggcttatgtggaatttcttggatagtttctgttgtaggcatacatgcatgaggacccttccttcatggcctcccctctccattttgtgagagtttagcctaagtgactccattttggtactggcaactttcacaagtttcatttttcttgtatgtaaaatggaggacaataatattcatctcccagggtcctgaaatgatctggtatttggaggttaccctaccagttttgtccaagcatccatcctgcatgacacctgaagtccaatatctttattcagtttcacttccttgatgtttctcagagtcctgaggatgcttccttgatggacagatccacctggtgggggccaactcctctggccgggcagttctgccagggctctgtgtctgctgctgctgcgcttgctgcttctctttacccggtctcctgactcagttccccaaaacacaccaaataccagaaggttcaagttaggggattttttttttttttttttaaatagagactagtctcaccatgttgcccaggctggtcttgaactcctaggctcaagtgatcctcctgccttggcttcccaaggtgtgggattacagaggggagccacagcacaccaccaagttaagggatttttaccaaagccttcctgatagcattgagacaggaatgatacagcgttgacacaggagaacagcacattccaggcagcagttttatatgactagcaaaagggaactgtttaaacagctgcagaagctaggggctgagaagaccctgaaaaaccagggtgtgggtcaagctggctaagaccaactagacccaacatggcgctggatttgacttaggtctcacctaggacctcattatatgctcattaacatagtcaatcacacacccaccagtgccaggacagatcctggaacacccatatttggtgtaaaaatgagtggcaccagatttctgagaaatcttcacatttttccaggaatcttcatgaatattccccctcttggttaaagaaactcatgtagatggaaactgcaaacccggttgcatgactgtctctctcttaagtatacctacactcccctttcttttttcttttctttttttttttttgagacgaagttttgctctttgttgcccaggctggagtgcaatggcgcgatctcagctcaccgcaatctccgcctcccaggttcaagtgattctcctgcctcagcttcccgagtagctgggattacaggcatgcgccactgcgcctggctaatttttagtatttttagtagagatggggtttctccatgttggtcaggctggtctcaaactcctgaccccaggtgatccgcccacctcagcctcccaaagtgctgggattacaggcgtgagccactgcacccggcccacactgccttttcttgagtgtgtactttttgtcttgcaataactctccaaactttcactattttctgatttgtcattgaattccttcccgcagtggcgtcaaaagcctggacaccagccggggccgaggtcctgcaggtatttggggaactcccctagcccactgatatctgcatcattagtattcttactattctcacctctcagagatcacagtaggtgaagctcttcccatactttctgtcactgtgtaccccagaagccgagggggtaggttctgttaacacatccattttgcaggtgaagaatcagaggctcagacaggttgaggaactttgccacggtcactcagccaatgggtgggagagcaaggtcccgtccaaagcattttccaaggtttggctagaatcagtggtggaaccacagctaatttcagctgtttcacacaaacacattaggtaactaaaccacctagtgagatagttattctattttcaattattttcccttccttttgattaaatcaaggaaattttccagttgtttctaatatgccagtaaaagttctctaatgcaattccaatctccctttctaacaaagacagaacaggcaaccgtatctagccagaacttaatcgcgttgttttgttttccttgtatttatttttatggaaatgaagttgattttctattgatgtagcaatagaaattttctttaaaaatatcaattgttaaaagtgaatagatgtacagaaaaatattaagtaaacaatggtgtgattcgtttgttgaaatgtcaaaaattgtgagatctggggcctcaggcttgggaacagtgtacgtaataaagaggaacttaagcctggatggcagactccatctcctgctctcttcagcgccgaggggccgcctctctcactcattctggcagagaccccgaggaggggcgcctcggcccagtccgagaaaagccagttaacatcacaaactcaacctttccatgatgccactttattgtccgaaacttctccatttcaaggggatttccatctccctttacataacaaaagtcccctgaccatgttcttcccaaaataaaaaaaagagcagccagtttttccttcagatgcaattaaatggcagcctgctttgcaagggcagtttattgaaggcctggtcttcattaggtcttaagagcagccccaattcccagcccagcccccagaaggagagaggtaaactcctccctgctctaagtgaagactttctacagtgcagctttgatggtcccctctcctgttctagcgtgccatgtttctctgggacatgtttctctccttggcttggcattcaaggcccttcacaatcagcccaatacggagaggtaaaagagcattaggccagaactctggacatcagggttcgagtgctagagtgaccccaatttgctgtgtgccctctgccggttccctcccctcttcaggcctgttttcccattcatagaaagaagagatgggattaggtgggtctcttccagggctgacattctctgggccacagcgagagtctgagctagttgaccagcacatagtcaaagaggctgagctagccagagctgaggcccagctctcaggcttgaccacctcaacctggccactaagatgactttgatgctctgccactttcaattgattttatgcctaagtgcgttatgtcagaaaaaacaggtctgctgggaaataagctggcctgccctgcttcttaaggggtctccttagataaataaccaagccctacagagtgaggaagctgctcacatctgacccctcaacactctctcctcccatcccaaaggactggttccagcaggaaagtctcctgttctgtcttttaaaagggagaataggtgggtttttttttaagttgctataaaacagatgcccagtatacaaatgtttggatcatatgaaatgtataaagaagagagtaacaggcaactgaaatgttttccacctacctctgccatgatatcctttgtaaacatttttgtgttcattctttcaagttttctctaagaaatagaaagacaaacatctttttaatgaagataggatcatactagaaatagttataatttttaaaaggtaaaatcatgactcttaaagaaatataaaatgagtgcttgtcaaagattttattttactcgattattaatgaaataatatattaaagccagttcaaaggagaatctgattaacagacaagtatatataggcaatcaagaatgcagaaataaatttgatagatgaaaaattggttattatttttagggtaataaaatgcgatgtttggaattgtctctgtacatttatttattgtacatttatgggacaaaatttgcatttccatgggcaaggataatttgcattacaattacctctagggggcgtatctgagtctcacagcaccaacgtatgttagcagtggtgaatccatatggatctgcatcaacctcaattcctgcctcctcaggagaaagaatttttctgaggtgtttaaggcagagtaagagactgaggcaaattttagagcaggagtaaaagtttattaaaattttctagagcaggaaccaaaggaagtaaaaagctacacttggaagagagccaagtgggtaacgtgagagagtccagtgtgtggtttgaccttggacttgggggggggtcttacacattggcatgctggcagggttgcgttactgttcccctgattcttccctttgggtgcgttgtctgcatgcacagtggtctgccagcacttgagaggggcgcatgtgcagtgtgtttactgaagttgtgcacatgctcacttgaggcatttttttcccttaccagtccggcgttcctacaggagggacatatagccgttacactccgccattttgcctctgagtgcgcatgcttgagcccacttgcccaattcctgagatcttgtcaggaagctactaatcaccggtttcaggtgttttctattgggaaactgcctttccctagccctggctttgaccaattctcattttagagagatagtataataaccacctgatgatcacctaacattccgagtgagaggggtccctctcctgccctgctcatgtctgactaactacctactgtaacattactattacttttctagaactcatagacttgtgaaatagcctagtcagagacagggaaagacccctatagaatcaggtaacccccaaaggatctagacaacacagagtatgccattaaaaggacacctgataaacgttcacaatttgtcaccaaagtatatatcatggttacaatagctagctaatatttggggaatgcttactccgggagtgtcaggcactgttttaagtactttatataagtattatgtcactttttataagtattattttacttataacgtactttataagtatattattattattattattttgagacagagtctcactctgttgtctaggctggagtgcggtggcacaatctcagctcgctgcaaaccctgccttctgggttcaagcgattctcgtgcctcagcctcccgagtagctgggattacaggcgtgtgccaccacgccggctaaattttgtatttttagtagagacggagttttgccatgttgctgaggctggtcttaaactcttgggctcaagtaatccacccgcctcggcctcccaaagtgctggaattacaagcatgaccaaccgtgcccagcctgagatttttttgtttttgttttttaagagaatttccctacatctttgccaataataagtaatatcaatcttttcagtatttgccagtctgataggttaaaaaaaaggtatatcggtgttatttgaatatacatttatttatttatttattttttagagacggagtcttgctttgtcgcccaggctggagtgcagtggtgcgatcttggctcactgcaacctccgcctcccatgttcacgccattctcctgcctcagcctcccgagtagctgggactacaggcgcccgtcaccacgcccggctaattttttaaaaaatttttagtagagacggggttttactgtgttagccaggatggtctcgatctcttgaccttgtgatctgcctgcctcggcctcccaaagtgctgggattacaggcgtgagccaccgcgcccggtctatacatttatttttatcacaagaattcaagggttatgcaaagataattatcagtgccagagattactttgttcctcttcctctctccctagtggtagagctataaactcaaagtaaggtacaaaaagagatccatctaaggccatcctgcaggttaggggcagaactaggattctctccagggtttctggcttcttcctgaaatagagcctttcctgtggactttcctgccaccaatgttgcttttagtctgaataccagtgggaatgactggggacccatcagtagtaaactcgtccttcagttggtcaatcaatagagatatgattagctaggctacctgaaaaaaaaaaaaaaaagaaaagaaaactgaatttgtatgtatcactaatgggccaaacacttaaaataataaataaataaataaataaatttattgagacagggtctcactctgtcacttaagctggagtgcagcagcacaatcatggctcactgcagccttattctcctgggctcaggtgatcctcctatctgagcctccagagtagctgggaccacagacgcatgccactacgctggataatttttaaaattatttgttgagacgggatctccctatgttgcctaggctattctcgaactcctgggttcaagtgatcctcccacctcggcctcccaaagtgctgggattacaggcatgagctaccatgcccagccaaatgtaaaataaataaatagactacaagaaaaatgagtaagttagttctgtagtttcttctataatttataaaacaaatcataaatgaaagttttaacaaattggactacaaaatgctttaaaatgtctacatgacaaaacaaaaacaaatttttttgtaaaaagtaactacaaatggacttgaaagacaaaaggagaattcaccccagatcccagtcttttaaacacaaaagcacatatccgaaatcatttatgctttcaccacttgtcaggccaattataggattagcaaagataatgcctgtgagcccgggctgttcaaaggcatttttcatcagcctaggcacggctgttagagctgtcattatgatctttgtgatttccagctctgcagccaaaatctgtctggaaaaagcatcggacatggatacaggtgtgaagggggagttgtccgttaatcacttttcctccaaagtggaaaagaactcaggttttcaaactagccacacccagattagaatccgggctctgcagcatttgcctttcctttgatgagatgtacaccatctcgaactcttatctccttgcttgtaaaatgggtctattgagacctgcatctccgaatgtttttgaggaatgaataagatgattagcgtagactgcccagcacacagcctcacaggtattttttcttctttttttggagacagagtctcactctgctgcccaggctggagtgtggtggcacaatcttggctcactgcaacctccaactcccgggttcaagtgattctcctgccttagcctcccaagtagctgggactaccagcacctgccaccatgcctggctaagttttgtatttttagtagagacggggtttcaccgtattggccaggctggtctcgaactcctgaccttgtgattccccccacctcggtctcccaaagtgctgggattacaggcgtgagccactgcgcccggcagagcctggcacttattagacaatcaaaaaatgtgtgctccccctcccattgccttctctgggagctcacccaggctcttcaagtcattcctccatcaatattggttgggcaagtatgcatgctggatactgcgcaggtgctgcagagaccagcattagcatgggagaggcactttctccttcctggagtttacagtctcactaggacatcagacacgggacagataattttacaaaaacaaattatttagaattgaaggaaagctatgaggaaaagcaacccagattgtatcaggagcctcttgactgagtcataggggatgaggtggcagggaggtgttcagaaaggtcctcagagaaagggaactgatggatgggggaatttgtgtttgttggagccatccaggctgagagaagacctggtaaggtctgaacaagatggcacagggttacctggggtgaaataataagaaatataagtattggtctctgcccgagtccctggcacagagctcctaaaattcttacaatttcctgagacataggtgaactaggagcatcttttattctaatatttggtctttgaccccagctcctgacacagaactcctaattccttggaatttcctaggtaataggggtatctttgtttcaataaggcaactcttattgggctcccggatgggggctggtcaccagaaaggccaagccactgttagaagcttggcgctttcagccccacctccattctctaaagagggagaagggctgaaatgcagttaataatcgatcatgcctacgtgatgaaggctctataaatatccctgaagtatgaggttcagtgagcttctgggttggccaacacatctgagtgccaggaggtggtgcaccccaactctatggggacagaagctcctgcaatcagcacctctccagacgttgtcccatgtgtcttctcatctggctgttcatctgtatccattattttaacttttattaagacactgaaggcttggcatggtggctcacactcgtaatcctagcactttgggaggccgaggtgggcggatcatctgaggtcaggagtttgagaccagcctggccaacatggtgaaaccccgactctactaaaaatacaaaaattagctaggcgtggtggtgcgtgcctgtaatcccagctactaaggaggctgaaacaggaggattgcttgaacccaggaggcggaggttgcagtgagccgaggtggcgccactgccctccagcctaggcaacagagcgagactccatctaaaaaaaaaaaaagagagagagagaagacactggtaaacgtgtttccctgagttctgtgagcctcactagcaaattaattggacccaagtaggtggtagtgggagcctcgatttatagctcattggtcagaagtgtagatgataacctactacttgcaatgtgtatctgaagtgggaaacagtcttgtgggactgagcccttcacctgtggaatccaacacaatctttagatagatagtattagaattgaattcagtaagaggacacctagcagatgtcccctggagaactgcttggtgtgaggggaaatacaccctcacattggtgtcagactgttgtgttgagcggtacatgagaatagatacacacttcggttttttgggttttttttctatatttaatacctggggataccaagcaaaggccagtgtggctggagcctgggcagggcagttgccactcaggctcagcactcccagcttaggaattctggctccagcaccccacatggattcatcccagcttcagcctggacatcccggggccaggaatgcactacttctggggtgacctggtccatatgggggctagttagtgcacccagaatttcaagtgcagcctgctggctgctgcaccactgcaaccaggaagtggacacccagccgcaagttcttgatcttaacggtggtgcagtcactcactctcctttgccaaggctcactttcccatctctgatatttatcctgtgttgtaattacctactcaaatgtctacctccattatcttaggaagcatgccttcctcctccttctgtccccagctcctagcacagaccctgcacacccgaggtgctgcagagagcacatttgttgaatgaatcataaacgatactttgcaaatatttacttatttgatcttggataactgttaccccccagttctatgttttgttgagcatctactgtgtgctagacacatagacacattaagtatagaatctcattgattaacatatatatatatatatatatatttttttttttttttttttttttttttgagatagggtcttgctttgttacccagactggagtgcagtggtgtgatcttggctcactgcaacctctgcctcccaagctcaagagatcctcccacctcagcctcccaggtagctgggactacaggtgtgtgccaccatacccggataatttttgtagagatggggtttcaccattttgcccaggctggtctcaaactcctggactcaagtgatctgcctgcctcagtctcccaaagtgctgggattacaggcaagagccactgtgcccggcccttagccctttattttaaaaaaattcagataaacagacaagttgaaagaacagtacacacacatccttcatctagattcagtaattttgccacagtttttaaatctctgtgtgcatgtatgtacacacagacacacatgcacacatacacacatgctcgctctgtttctctctctcttcctgaaccatttgaaagttgctgatattaagactcttcgcttctaatatctttagcaaatatctcctaagaggaaggccgctttctacataatcatgatgccattgtcacgatcaataaacataagacacaaaagtagtgtctaagagcagaccatgtttgcattctcctgttggcctgatatatcctttatagctttttaattttcgtccagtagtatagagagcacataattctcataactctcaagtctccattaacctggaacagttccctccccctactttgtcttcagtctttcataatgaaattaaaaattttattattattattatttttgagacagtcttgcgctgtcgcccaggctggagtacagtggcgcagtctcagctcactgcaacctccacctcctgggttcaagtgattctcctgcctcagcctcctgagcagctgggactgcaggcatgcgccaccacacccggctaattttgtatttttagtagagttggggtttcgccatgttggccaggctggtctcaaacttctgacctcaggtgatccacccgcctcagcttcccaaagtgctgggattacagactgagccaccacgcccggcctcataatgaaattttgagaaatccaagccagttgttttataaatgttccacaatttaggtttgtcattataagattaagttatacatttttgggccaaaatgctattcaggtgattctgtgtctttccagggtgtcacacatgttgtcagcttgtctcattactggggatgctaagttttatcagttggttaaagtggtggttatcagaaatcttcattgtaaagttacctatttatctttgtaattaataagtaatttctggggagacactttgagactatgtggatccaacaacttctcacccagtgttttagcattcactgataattttacctgaatcaattatttctatcatggttgcaaaatagtgtttttctaatttcatctacactttttctttttggttagaatatcactatatactcatggattctttttttatacactcatggactgtataaattcaatgtgtagaaatcctttttgattcaatgtgtagaaatcctttgagtagagggatattttttaattcagtgtgtagaaatcctttctgatcacttttcattttgatattcaaattgtctcatgtttgtccagtgtgagctgcttgtttgagctggctgctgtgtgctttgatgtggctccaatagctttgaaccttctttgttttctggtaccagatattccaggctcaaattttacccttattttatggaggaggaaaaggaggctcagagagagaaaacggcttgctttctcacaatgtttgggagatcctgctcaagctcaggacgttcaattccaaatttttaggaaagtagctaaactggaaggccagacaatcctatagtgcagaaaggacctcatgaagagatgtagctaaatcgttagctgtctgcgcacagagcttgcctaataagatggagacatctggatggtatctttgaacttacacaattagtaacacatttcaaagatattttatttattgaggaagttgcaatgtgggggataagagcctgggttttggagtaaggaagaaccaaggtctcctttaagactcaagcagattcagcccttgtgtgtctctgggtaagttacttcaccttgttgaatcccagactttttccatcggtaaaatggggtaatcatacccacctcatagttaaatgggttcattcatagaaagtgcctagtgtaatgtctggcacatgctgatgctcaatagacaaaagctacctttaccatcagtgccgttgctattattattattaaaatctgagaaaatcctgttattcagtgggttaatgtgatagaaaaaacaatagatttagattcttaaagaccctcgcccaccctctgtgacctaggataagtcctactcccactctcgtgaacttcattttattcacacgtaaatcagggttcataatctcttcactgcaaacttcacagcatcactcaatggatttcatgagcacctactacgtgcagggtaatcacattcctaacgctaaaaccaaagggtaagcatcgctatactcctcctttagtacatgatcaattggcagtccagggccaacgagaagcaaagctgggattccatcaggcactctctgacctccatgtttgtccttttccataggtcacactgtttagaaggagaaagaagagctcgctgtgaaaaacgctccacaatgctgcagagccttgtgaaggtggaagagtactctcatcagcaaacggcattccttccatggaaaatgtcattgggaggaaagcaggtgactttggatttctttttcttcttttctatccttgtaaaggatttccttcttctctatctttgataactcgtgaaagccttaggttaatattatctaccaaggactctacacttcaaataagaactgggtgaaggtagcggagaccgagccagcccagaaccaactgcctcaactgaagaaactgaccagaaaagccctttgaagctgtaattaacttcagacatgattttgaagaagaagaagaaaaaacaaaaaacaaaataacagtaatgtcagtgggtatcagaactccagccaattcaactgagagctgggaagagggaagagaaagtgctgcaaattttcaacagagtgaccacagagtcctacagtatgagctctcgtggtgatgtagcaggcaggcttctattgttttaaagatggggaatcatgaaaaagagagagagaagggaaagatgggaaaaaattttaatcttaaaaatataaaagcaggccaggtgcagtagctcacacctgtaatcccagcactttggggtgccaaagcggtctcaggagtttgagaccagcctggcctacatggtgaaaccccgtgtctactaaaaatataaaaattagccagtcatggtggcgggtgcctgtaaatccagctacttgggaatctgaggcaggagaattgcctgaacccaggaggcggaggttgaagtgaactgagattatgccactgcactccagcctgggtgacagagcgagactctgtctcaaatatatatatgtatataaaagcatttgcagctattccagattaatatgggaggaagtgatgggagagaccagaagatttgataatcccaaacctaacttgttataatgtggtacaatgtagactggttttccttgaggtcagggactggacctgcttcatgactgtccagtgctgagcacagggtgtggcatctggtgggatcttaggaaacatttatgtaatgaggaaatctaggaaatgtgattgaaaatcttcttgacaccttagggccctcactatgattgcaaaaattattagtctgtatagattaaagccaggcttctgatttatctggtggggctggttagtcagttatccctttttcacagcctcaggcactcttggcagagttacataagtaaaaagccatgtgtgtatgcatgatagggatgaacgtatcagttaaggggcagactccaattttgcaacctttttaaaaaatatattttattgtgattagaacacgtaacatgaggactacccatttaacaaattttcaagtgtacgatatggtatcatcgactatagatgtaatattgtacagcagatctatggagcttattcaatcttgctatcctgagccaagaaaataaaaagtatttgtgtttgtgaaattgattggaagaactctgccaaaggaaaggcaacagttaggtctcaggcaggccggaaaccaaaactccatggatcatagaagtagagactcatgggtacttcctttcaagaacctccgctttccttgatgtttgctttgtggctgaggagacaaagtggctcgatggcactctcagcttacaattcagaggaaccattgttgagtcccctgatagaagttttcatcccttgggctttgtggtggattaaagacggctacaaattccctatcacttctctgttgagaggtgaaatgtgtttcctcagcccttgaatactgggttggcctgagactgcttaaccaacaatatgtggtagaagtgatgctctctgtcagctctgaggtaggcctttaataagactaacaacctcctcttcctccctcttggagcccagagctgccacataagaagtccaggcaagccaggcgcggtggctcatgcctgtaatcccaatacttagggagactgaggcaggtggatcacaaggtcaggagttcaagaccagcctgattaacatggtgaaaccccgtctctactaaaaatacaaaaaattagtcgggcgtggtagcatgcacctgtaatcccagctattcaggaggctgaggcaggagaatctcttgaacccaggaggtggaggttgcagtgagctgagatcacgccactgcactctagcctgggtgacagagcgagactccatctaaataaataaataaataaataaatatccaggctattctgccaggcacacagaataagaccactgaggcacaggaggtcaaataaagatgccatctttgatgtccagtccagttaaaccttcagatggttccaaccccacctagcaactggctgcaacctcgtaagagactccaagcaagaaccactgagctgagcccagccaactcatagaaccatgagagataacaatattttactatttaaagccacaaagttttggagtggtttgttgtacagcaacagatagccaaaagagaccctaaaacctatagctagcaaggcctagagtctcaggacaggaagtctaacatttggagagcagatgttaggtgtcaccttgagcaattccaccccttcgttcctgaagcaattgtttcgattggaattcagtttgccttcactgagcaacagaaaaccccagacaataatgccttgaacaaatcgaaagtttctttctctcacaaaagtctgggtaagtgatccagactggaatagtgctctaagatgtcagggaccctggttctttatgctttttttatgcaatgcatgacctaagcctcgtgggtcaagatgacacttcaggcaataggacagaggaagggatgcaaacacaaagggtgctttctcctgtagaaggttatttaaagccaccacatgtggcttcttcttgtattccattggttaatatgtatctcacggccgtgcctagctgcaagggagactggaaaatggtatcttgattttgggtggccatgcacccagctctaaattctactacttctagtaagaaaggctattgggagacactttgcagtgcctgcctcactgctacatcttgaaaagtaatagagagacacaggaaatggcatcacatatgggatgctgactcacagcaccgatcccttccggaggggagcaagcagttatctccccatgggcactgtgagcctccacaaggccattctactgtgctataggagccagctgctcctgggtcatgggtggggtctgttaggtgaagagtgaatcccacaggccttaagtcactgccacttttgccatgaagtgaattccttgataagagggagcatcgtgtgacatacgatgactaggtaaaagcttctataagccctcaggctgtggtgctggtggaggcacgaagggcagggaaagcaaatccagataaaaaataaatgtagggttgggcatggtgcctcatacctgtaatccgagcactttgggaggccaaggctggaagatcgcttaagcccaggagttaaagtctgcagtgagctatgattgcatcaccatacactagactgagcaacagtgtgagaccccgtctctaaacaaataaattaaatagttaaataaataaatgtaggacattgccatgagaacaatttggctgttccagatggagttagttcccagctgagaaacagggaggtgtggggcagaaggaagagtgttagcttccttccttctccatgagagggaggcgcagaggaaaggctgcagaccaagatggttagtgggtaggaattctccaagttctctcgcaagccccagatatcaccatcctttcctaaaggaaacctggcaaagtcatgccgttggctgtcactgaaattcagcaactccccgaatccgagtttggctttagcaatctcgcacccatggccccagtgaacagtttccatctggccagagaaaagtcgtgagtttcactttgtgccttgtggcaaacatctcaagacgtgagcttgtccttatcctaaatcaagatacctgatgctttcagaagcagccaccctactggtttccacatctttcatctcccttttaggtggctgagaattttagcttcagcttgtccaaagtcccagattacccaaagagattatgtgcttagccactgtcttccaagggctggtcgttcctattctggaagacaattaggattctcagtgcctctctccctgtccagctcaagaatcatggatcacttggaggaaaagctaagctcctgtaataaaaaggcaaactagagtagcctatttccccttgaggtgagtggcccagagcagaagggcagctttggttctttgtcgctcattcttccccagggcagtgttctcttctgcatcggtgcagctgggttctggctggtgggaaagaagacagtggagaaagcttgctggttatcttagaacccaggcccggaaatgacacgtgactcccacttcattcccctggtgagaattcaggcacctggccaccctaaacacaagcaaggctggcaaagacagtctagggggacagccatgtgcctggctcctattatacttaggcaaaaaagtagaatggaaagccttttggtgaacacctagcagtctcggccacatattccaaatagctcttatttccttgagggtctgaatgagttttctaggactgccataacaaagtatcatgaactgggtggcttaaaacaacagaaatgtattgtctcacactctggatgcctgaaatctgaaatcaaggtgtccacaggaccacattccctctgaagaggcaatggaaggagctgttctccagaccgcactcctagcacctggcagccacaggtgtttcttggtttgtggctgcctcactctaattctctcttttttttctttttccattatttaacatgttgttgttattgttgtttgtttgtttgttttttccccaagacagagtcttgctgtgttgcctaggctggagtgcagtggtgcgatctcggcttactgcagcctccaccttctgggttcaagcaattctcctgcctcagcctcccaagtagctgggactactgatacacgctaccacggccggcaaatttttgtatttttaatagagacagggtttcaccacgttggctggtctcgaactcctgacctcgtgatctgcccgcctcagcctcccaaagtgcctggattacaggcatgagccaccatgcccggccaacatgtattttcatttatatccaaatatcacattttctacattaaaattatactgacttcccccgtaccctacaccctaagagaaaaaaagaaaagaaatttacacaatttgaaaggtagaatgcatggagtagggaagttgctattgcacctgagtaacaaagaacagagagaccaaacagtcaataaggcacaactgcatagaagacagctcagggcttgcatcaggaaggagcaggaataaaactccaaaacttctaagtgccaccacctgtgccacaacattaccctgaaaaggcagaggtaggtccgaaagcagaaccaaatcagggattttccaaaggctgcttcctaacagagattaaaatatccacaaacatgagagcctttgcttctcaccttgccttcagcatctggtaaacactttagaaacttaaaccactgttcacatgtcagaatgtagaatggctataggtttttctttcttcttttgttgtaccccaagcaaccactctattaatgattttagtcatgtgattcttctgcatggaaactcagtaaaggtcaccaaagacaaggcttttcactgctatcagataaatatcagctgtgcaaaagttgcaggattttgtgtgttgctcagagagggagagctgtaagacacaggaatctcaatgcatatgtaataaacaggaaaaggaaatttcttttgctcatctatttattgtataagaaagagcaagtaggcagtcaaaatcatctgctaggctaggggtgatgtctcatgcctgtaatcacaacactttgggaggccgaggagggaggatcacttgagcccaggggttcaagaccagcttaggcaacatagtgagaccctgtctctacaaaaagaattaaaaaattaactgcatgtgagtagcacatgcctgtagtcccagctacttgggagactgaagtaggaggattgcttgagcctgggagcagctgtgctcacaccacggtactccagcctgagcgacagagcaagactctgcctcaaaaacaaacaaacaaacaaaaccaaccaaccaagcaaccaaagaaactatttgcttagagcagcagcacagaaccacaggcacatcaacaacccaaaagaaaatgctcaagaaagagcatcttggctcttttgaaaggagtcatcttttagacctgatcttgcccctttaatttagagaccaaagcattataactcagaggctgatactcttgaggaggttgagaggtaaagtccaagagacccagataatgaggacattattaggtaactaactatatcactgtgtacaatgcaaacatcaataagaaaacgtcacctgcatccctgcagctacttttagcaaagcactgaagacccaggttttctgaatagggaatagtttgaagtctgttagcagtttaaagcattcaacactggaacaatatgttacgtattctttgtttttaattataggttaacacggtaaactccaacacaaagatgaggctaggggagtgctaaaggaataaagaaaacagaaccagcatttcacaagtatattaagcagtgatgaaacagcagccagtgctttgcagagtctcaagggtaaaatttactttgctgctgtgatggttaatacttagtgtcaacttgattggatcgaaggatgcaaagtattgttcctgggtgtgtctgtgaggttgttgccaaaggatgttaacatttgagttggactgggaggggagacccaccctcaatctgggtgggcacaatctaatcagctgccaatgtggctgggataaaagcaggcagaggaatgtagaaggactagactggcttagtcttccagcctgcatttttctcccattctggatgcttcctggccttcaacatcagactccaggttcttcagctttgggactcttggtccttcgaccacagactaaaagcttcactgtcagcttccttacttttgaggttttgggacttggactggcttccttgctcctcagcttgcagacggcttattgtgggactatactttgtgagcgtgtgaatcaatactccttaataaattcccctttatgtagatatctatcctattaattctctccctctggagaacctgaccagtacaggtgctcttcagcatatctttggggaagattaggaacagttgccaaccagtatccaaagtctcatagacagtgtgattttcatgaggaccctgaaaaataaagttcctctcaaacttctgcagaaattccaagtcaagaagatcatctgagctaagggcttcttctccaactacagcaatcatggcttgtacatccttcccaatagcttgcctacagctggttacatacatctgcatgattcttcctggtcatcccttctccaatagcagacttcatgaacagtgatagttcaggcagcacattgataggtgggtaaatctctctcttgtgtagctgtctgtccacatagatctgtcccagtcagttcagagatgggtgaatgatatcgttggcaggcatggtaagagtaggaatttgagtaattgagccatttctaccttctcctcgacctgcatgttcatatatagtggctaagtctgtataagtgtaacctgtgaagcctcatcaaccaggaatctcttctctggctgtagaaacctcttgaagtgcttcagtagatgaactcatatctgttaggataaccaatacatgtttctcatattggtatgccagaaattcggctgtggttagaaccgggtgagggatggcaatccacccaatagttgggtcattagccaagttcaaaaacaggcagatgttgtccattgagccattttcttcaaaaccagatttgaagaaccaggcagtttccatgtttacatccttagcagcaaatacaattggaaaattttcctcagtgtagtctacgtctttggattcatttagcaaaccagtctggtggcagatttgagctgcaatctttgtgtagtaacccagcagcagagaagataaaaattttctgccccggcaatactgttcataccaactatggctgaaatgctggtccgaatcatgtcctctgggtagatttgacgttgaggattggttggccatcgcatgatatcaaagaaatcttcagccagtacaagaggacctctgtcaatgggtttttcccgatccaactaatacccaacaaagcatatcctcagacactgatgtttggagaatatccccagtcccttgaaatacctgaaccactgccttggagccaccaacttctagaacttgcccatgtctctgtgccatctagtaatgtccagtggacaatatcagcgtctatgggaaacttaacgtgatctaagatcactagtagaccatggactcttgatactgtgatgtatgtaaggcaaggctgggagaggtagttccaactaactgccagcacctgctcctgagctcccaccaccagcgggcttgggtagtttgggtgtggcccattcataaccccacacatcgcctgcagcgccatcatcttgacatagcattttccctgtgtgtctgcacattgtcttccctctgtatttgtctgtttctgtgtccaaattcccctttttaagtgacatcagtcacattatattactattagggcctagcctgattacctcattttaacttgattatttctgtaaagaccctatttccaattaaggttgcattcagacatcctagaggacaggacttcaacactgttttgtgtaggggttggggattcaactcataacaattcaactcataacaaagtctgctgtctgcaatcagctcttgggtgctgatatctatatgctctgtaacagaagcaaacctaagcaaagaaagagaatgtactggaagtatattgggtggctcctggaaccaaaagagaacttcaacaatcaggcctcgggagaggcaaaaattcctggacatctctttagggcctgctttccagatgattctgcgtcaatatccttctggccaagtatcctttttctcaagatacaaattcttggaagagtcagttgggttagcttgtggtggaaccaggacctgtttggggcttgtgagtgggatcaagtgacggacaatcctgctagggcctcatggggtagaggaggggcagttctccaaaagaaagtgaggggcggccactaaagatgggggaggcatgtgatgtgcaggtgaaaccgcaggagtttgctacacattgtactttgtttaagaaagacttctgctctgcagctgtgtttctaaatgttatggcacttaaaggagccattttagtcatctggaaaacgcagagttgtggggaaatgcagtgtcatgtgttaaaaagagcactcttggtgaaatcaggagagcaggttttgtttggcttttttaaatatttgcagatggtataattccatcttgaaaacaagggaatcaactgaaaagctcttggaaacaggaaacttcaaccaagtatcaagttactaactggaaataaaaataatgccatacagatcaattagaaagaaagcataaaagaaccaaagatgttattcaacttagctacaaaggcagcttgtaaaagaataaactcggaaagaagtgcaaagggcatctattaagagaaaacatcagattctccttggaggcgtaaaagacaaagggtagaaaaacttgggataataaagatgtaatttctccctaggtaaatggattaattcactgaaagatttcaggtgagcaaacaaacaaaatcaaatctgagccaatcaaaatcctaattaggtcttttaacttgaaaatatgagtctaaaactcataggaagagtccctgtccgtggatgtcatatcctcagccaaaaaacttccccacaggttttgatttttggttctgtcatttaatgatctgtgagaccttggggcaggtaatgtaacctcttcgggccttagttttttctcttgtgaagagggataatcctatctttctgcttaacagagctgtagcaatgatcatgtgagagaaagtatttggaagtgtcttataaactgtaaagcacgtttcatgctatagttgctatttttattcttccatgatgccagataaataggaaaaatcacaatgcaaaaggagtccattgctctgcaagaagataaacacctcttattaaactcggatacatcatgatttgtaaatatttgattcctgtgaaggagagaaaaaagctaatgcaagctgtttgctgctcagtaagtgagggctcactctctggttatggaactgagcaaaatgcttatggcctcccctctgtctccaaccccacacccctgtgttgtcatctgtagagtgaaaggttttggacttcagggtgtttgacagcatgaactttgggtctctacagatcttggttcaaaatgtagtgccagcaattactttggacaacttattatttcttttcttgggttccaaaatccatcagacaggcatgataataatctctattattatatctattagtatttctcaaagggatgatacctacctcatcaatcttcaggaagacttgagagttaaatgggataataaatactaagtgcctggaacctagtaaaagctcaataaatgagcattgtaaataattaactatcataattaccatcattattattactctaagggcctttgcagctttaaaatctaggataacatgtcagagaaaagctaaaacagggaggaaacagaaaagattcccttaatacggcttgaatcagtacttgcaagggagagatttttctggaagatggcttgtgtattcatcataaggcctcatttaaccttggtgactcacagagttcggctgggcctgctgtcctctggaaaaagggggatagaggagtaacgaaccaaatggggctagacaggggaaagccatggcctggagaccacagtggatggttccttagagagtctggtccaaggtttttaacttttataaaatatatgttaaattgagaaatttctttttctgcaaataagttttgaggtagggactgttggttgccaaaccaaagctatgcccttttcattccttgacagcgcagctctgataattgttcaggatcagacagctgagtggctcaggagagaatggtgcagcctcaggacaaggggcaggaggaagcctgattactttggccagtgattggtttagaaatgggcatgtgatgcaattctggcctatgagataacaggggatgtaaggcatgtcatcttttccttaagaaagaggaaaattttcctatagaaaccctgcctgctcctgggcttctgcgtaaattttcctcatccttaaggaaagggtgatgtacctacatctctggcaggaacataaaacagcacaacccctatggagggtacattagtttcctatcactgctgtaacaaattaccacaaacttggtaacttaacacaacacaatttattctcttaaagttctggagttcagcagtctccctgggctagaatgaaggtgttggcagggctgtgctccctctgaaggctccagggagaatccacttccctgccttttctggcttctagagtttcgttccttgcattccttggcacatggttccttccttcatcttcaaggccagccacgtagcatcttcggatctctgttctgtcttcatactgccttctcctccatggtaaaatctccttctgcctatcctttataaggaaacttacgattacatttagagatcacttcgataattcaggacattctccccatcttaagattcttaatcacatctgcaaaatcccttttgccatataagctaacatcccaaagttccaggaattaggatctggttatctgtaggggccattaattagcctaccacagagggaattttggtactaactagcaaaattacttgtacatttatttttttcaaggtcagggttattgaggtataatgtacatatagtaaaattcatttttgaggggggtgggagcagcgttttgctcttgttgcccaggctggagtgcaatggcacgatcttggctcactgtaacctctgcctcctgggttcaagagattctcctgcctcagcctcccgagtagctgggattacaggtgtgcaccaccacgcccagttaatttttgtatttttagaagaaacagggtttcaccaggttggccgggctggtcttgaactcctgacctcaggtgatccacccatcttggcctcccaaagtgctgggattacaggtgtgagccactgcacctagccatatttttagtgcacaattgtatgagttttgaccagcacatatagttgtgtaattatatcacaatcaaaatgtagaccagtttcatcaccccaagaaattaatttatgttgccccttagtagccaaaccacccccttggcttagcccctggcaaccactggtctgttctctgtccctgtaatattgtctttttgagaatgtataaatggaatcatagcatatgtagctttttaaatctggcttctttcccttagcacagtgcatttgaaattcatccatgttgtagtgggtcagaagtttgttcctttttatcattgggtagcaattagattaaatagatgtatcacaatgtattcatcagatgaaagaaacttgaattgcttctagtttttggtgattatgaataaagcttctataaatgttcaggtacagacaaatgtgaaaatatgttttcatgtctcttgagtaaatatgtaggaaaaggattgttggccgtattataaatatattgcatgttacattttataagagactggcaaaatgttttccaaagtggctgcaccattttgcattcccactagtaatgtatgagagttccagttgctccacaacctcatcagcatttagcattgtcagttttctttctcttaattttagccattctgagaggtaggcagtggtatagtaatcccacttctagatagctatcacaaatatgcagtagcaaaaatataaaaaggtgcatgtgcaaggctagccactgcagctctatttgtaatagcaagaaaatggaaactcaaattttaatcgatggaaaactaattgaataaatgatggtacatcccccaaatgaagtattatgcagctactacaagggacaagaaattactccactactatgtgtgatctccaggatatatttttaagtaaaaagagaaaagtatgtatagtatgcaatcatttatctacaaataagagaaaaactataaaaatttaataaaatattcccatagcaaaagggaaagaatagaaaggaaggtacagggatggaagctaggcttctaaaaatatagctttagaagctagcttctaaaaaaaaagtagatttaactttggaacaatgtaaacattttatgtaattacatgcaaaattaagaaaaaatcaaattcctagaaagtaaaaataatgttaaattaaaatgaccctgtgtgtccagttgatgacgtaaccacacaaagaagactttagtgaccttaaatcactatcattcgattctatactcctagaagactatatctggcaaaaagagctgtgtattacaggatgaaaataataattatgttgatgtccttaaaaattaagatatttggcatagttgataggagatataaatctaagattgataagattgagcaaaaagtctatagtcctccacttcaattggaagtatcagtatggatgcattataccttttctttctttctttctttcattttgagtcagggtctcactctgtcacccatgcaggagtgcagtggcatgatcagggctcactgcagccttgacctcctgggctcaagcaatcctcatgcctcagcccctctagtagctggaactacaggtgtgcaccaccatgcccagttaattttttaaaaacatattattagagacaaggtctcactttgttgcccaggctggtctcaaactcctgagctcaagcgatgctcctgcctcggcctcccaaagaattgggattataggcatgaaccactgagctttgtcccttttatctttagaaaacaatatacatctcctagctatgcctactaaaaataattgaaattcaagtaaactgtgaaaagaaaaacactttttaaaaaagagacgaggtcttgctaagttgcccaggctggagtgcagaggctattcacaggtgcaatcatggctctctatagccttgaactgttgggctcaagtgaccctcttgcctcagcctcttgagtagctaggactacagatgtgtgccaccgtgcccagcttgaaaaacgcatttaaaagacaaccagagaaatataaatgttatagtatatttactgaaactcagaaatgattgtcaatatgttaaactgtgataatggtattgtattttttaaaaagaacttgtaccttttagagatatattctgaaatatttatagaagaaataatatatctaagatttgcctcaaaattatctgagggcagggaaaggaaaggtatgtgaacacgtagatgattcaggatgagtatttagtggcaattgtaaaagctgggtggtgggcacattaggatcattatactactctttctacatttgagtggttttaacattttccataataaaaaagttttttttttaaaaaggagatgtgaagatagttgtctgaggatgctatgctcagagctgctgcagtcactttgtgagaatgaaagagcaagcttgaggcctaaagcatccaatttgataggtattccatttctatgaattcaaatttcttaacttaattataaagctagttaatgcgaaaatgaggcaattatcatggacacaaatattgaaactagggtttatccatgtatattcatgagacttttttggttgcaactaatagaaaccttagcatagtttaggcaaaatttagagatttattatggaaattcagaattctaggacagaagtgccaccaagactcatgaagaacatagttcacaatatcaggtccctccatatcctttctccagctctcatcgccgctcttcagcattaccatgactgtctatcaccaccctctcattgcagaccagcttccttcattttccagcccacatcatggaaaacttgcacaagtccaagttcagccattcagatagagacaggtttttttctccagacccagttccaaaacttctggaagaagagcttgattggtccggaagctgagattgtcccgtccagtggggagggcccactcctaagtgagtcatggccagagtttaaggcgtgtgtgatatggctgctcctgtggttcctgtggtgttcctgtaggcagaagagcaattcccagagacgtgtaggtgggaagtgggaggcagacagagcaataggcatctatatagttgagtcaggccagatcatgagatcatgaatgggtgcaaaaattgctgagaatgatgccttgggcaggttgaattttggttgactgcggaaagtcagccagcaggggcaaggaagactcggttcccggctgccccagggtgctcacaggggcttgctcaagttcagtggtcattgcagcccatggatagtcaggaaccagccagaccagaggtgctcaggccttggtgctcagggaaagaaaggctatatcagtgctcaagggcccatctactcccacgcaagggagcccccgccacactgctgtctggcatttgtcccacattgttccaattcttacaccatcaggcttaaaaatacaacgcaacaactgtagccttccaactgtgcagcctctgacttccaccttccattctagtgacatagtattgagaacatcctgactcacacccataagtagttgcaaactgaaatcgtttttcttcatcttccattgcaacgtcagtctggcttttaagctacttttcaattaaactgatccagaagcttgagagagaagtgagtagaaaatgttttatttgagtttaaatcactaatctaggcaatagctgtgggtattctgtagcattcatttgaatcaggaggaaaagagcatccaagatttaaaataagtacaaaaagcatccaaaatagaataatcaaatcaccaaatcaaataatcaaattgacttagttgttacactgggatcctaatgaaccccaatgttagccctacttgactcacgagattctggtaatgggtcactgataaagcccaggtaaagcaacctcacccccccaccccaccacccccagtgcccaccacaccccgccactgcaagggagtctcaccaatgaaggccatccatgaagaggggcagtcttcagttcattaggagagtatgtatatgctatgctatgtatttgcatagaaatgaataaggtgcttccacattctctcctttatttgatcccaacaaagggagttagataggacagatgttattttataaaggaggagactgagtctcagagaagtgctgtaaagtatccccattagccagtgatacataaagaagaaaacaattgttataacttcaagcccttgactctttttttttagcaggggggtcagagtctcactctgttgcccaggctggagtgcaatgatgcaatctcggctcactgcaacctctgcctcccaggttcaagtgattctcctgcctcagcctcctgagtagctgggattacaggtgtgcaccaccacacccaagcccttgtctctttccttaatcctccctccctctctttcatcttcctccttctcccttcttcccttcccttccttcacttcccttctcttgccttccttctttcctttttctctcctcctctcccttccccatctcgtccctccttccttccataaatttattgagtcttactatgggtcaagacctaggcttgaaactgggggtttgaaaatacatgagatctggttactgctctgaaagaacacagcaggggaacaggtgtatccaaagctaaaaatggatacaatatggaggcattcagaggcaaggaggacattgaactgggccttgaaggataagtaacacgaccaggtagaggtcatggaaatgggaaaggcatcctaggcagagggaacagagagagcaaatgccttagaagacacacaaacatagattattggtggggtgggcaggggagaagccctggtgtctgggaaagaaggcgagtaggtgaggctggtgctagatcaaggaaggccttggaggctgtgctaagaggtctggaaggtgatgggggctgttgaagatttttaggcagggaaatgacagggttatgtttttaagaaagatcatttagaggccatcgtgtagtggatgattagcacgagatgagattgggggcactgaggccagttaggagacttttgtgacaatctagatgtaagatgataacataggagctgaggcaatgggagatggtgaggaggggcttatttcaaaagattgaggagatagacttgataggacttggcaacagaggtgcaggcaggatgatgtctaaggagatgcaagagactgggcgtggtggctcacacctgtaatcccagcactctgggagggtgaggcgagtggatcacctgactccaggagtttgagaccaacctgagcaacatggtgaaacctggtctgtacaaaaaaaaaaatttttttttaaatacaaaaatttagccaggcatggtggcatgtgcctgtggtccaagctacttgggaggctgaggcaggaggatcacctgagcctgggaggtggaggctgcagtgagccatgatcgtgccactgcattccagcctgggcgacagcctgagaccctgtctcaataaataaataaataagatgcaagaaagtaaccatgaagtggttcatgccacttaattccttcccaaataacatgtccttatcatcccttcctttcagaggatatatttctatttatctattctttctctctgatacgactttctcaagactggttctcctttctggtttgggcagcaatatttttttccacttcctgttttctggtgtctgattcctcaataaacaaggtcatggtgagaaatagccacatgtatacctggggactttctgccctggtcaccagtgattggaccaggtgggcacgtgagcaagctgggccaatcagagtccttctctgtgttcttgaaattagggaaagaaaatggctgctgctttcttgaaagaaatggaaactaggtggctttggctgatgattcaagtggctgtttcttgagaagtaaaaaagctggttttttagtgagtgagaataatgacgtctatgctcagggagaaacagatgagagaagaaagagggctgtgtggttcccatagaacttggagatgatgctaccttatcctgaagccgggatgtaagtctagcctttggctccctgttgcttgagctagctctggtcgtactttcatacatttgtctacagatgctgttacaaaactcacacaccaatgactatatcttctggaagtacctttgcctttgtgcaatttactctctagatccttctcttttttttttttttttttttgagatggagtctcactctgtcgcccaggccggagtgcagtggcacaatcttggctcactgcaacctccgcctcctgggttcaagtgaatctcctgcctcagcctcctgagtaactgggattacaggtgcctgccactacacccagctaattttttgtatttttagtagagacggggtttcaccatgttggccaggctggtttcgaactcctgaccttgtgatttgcccgccttggcctcccaaattctgagattacaggcgtgagccacggcgcccagccgatctttccctttttggcttatcacacctgtttggtgtgtgtgtgtgtgctttgagatagggtctggctctgtcactcaggctgtagtgcagctgtgtgatcttggctcactgcaacctctacttcccaggctcaagccatcctcctaccttaggctcccaagtagctgagactacaggcatgtgccaccacgcctggcttattttttgtatttttagtagagatggggtttcaccatgttggccaggctggtctcgaactcccgacctcatgattcacctgcctcggcctcccaaaatgctggggttacaggtgtgagccaccatgcccctccaatccttcccttttttgcttatcatgcctgcttggggtgtgtgtgtgtgtgtgtgtgtgtgtgtgtgtgtgtgtgctttgagacaggtctggctcctaccttagcctcccaagtagctgggactacaggcacttgccaccatgcctgactaattttttgtatttttttttgtagagttggggtttcgccacattgtccagactggtcttaaactcctgagctctagctatcctcctgccgcggcatcccagcatactgagattacaggcatgagccactgcacccgaccctgtttgtttttttaagtaaatttttgaactgaagtataacatacctacagctgatgtgttctttttttttttttgagatggattctcactcttcacccaggctgaagtgcagtggcatgatctcagttcactgcaacctccgtctcccgggttcaagtggttctcctgcctcagcctcccaattagctgagattataggcacctgtcaccatacttggctaatttttaatttttaattttttttatttttagttgagacagagtttcaccatgttggccaggctggtttcgaactcctggcctcaagtgatccacccaactcggcctcccaaagtgctaggattataggcgtgagctaccgtgcccagcctgatgttcatttttaaacaactcatttgcaattatttttaaaatcatcattctaaattaaatataagaaataatattgttatatcacctctaaacattgaaaaatgtgctgatgctggtaggtaatggacaatggaggtgttgagggtaggtgaatgggtgtggagaaagacatacaaatggccaggcgcgatggctcacacctgtaatcccagcactttgggaggctgaggcaggaagatcacctgaggtcaggagttccagaccagcctggccaatgtggtgaaaccctgtctctattaaaaatacaaaaaaattagccgggtgtggtggcagacacctgtaatcccagctactcaggaggctgaggcaggagaatcacttgaacccgggaggcagaggttgcagtgagccgagatcatgccattgcactccagcctgggcgacaagagcaaaactctgtctccaaaacaaacaaacaaacaaaagacatacaaacaattcaagtataatttgaaaaattagaagcatttattcaacaaatgcttattcagtgcccactatgtaccaggcactgtaaaaaaaaaatgccaggaagtcagtcccatagaacttaagtgttgatgggggtatataaaaagagatgtggccaaaccaggaagggtcaattcattttaccccagggataagaaatggggaaggtagcatttgagctgggcttaaaaggagaagtagaattttgacagttggagtaggtagaaaaagggcattatatgttcagaaaccagcgtgagctaagatatgggggagtgatggttcaaggacacgcttggggagttgggagaagactcctgtggccagtggtggattatgagtttgggaaggtggacagtggcaggaaatgaagctggaggggctccaggaggcagatttcaaaagatcttgaatgctacatatgacggagacatttactgttcaccaagtatctatctacctactttccacatttcctagtcttttggcagttggaggaaccacatgactagtttcaccaatgggctataggcaaaagccacacatgttagttctgggctaaagcataaaagagtgagtgtgagctctcccttagctttcctgcctcactgtaatgaacaaggcagccacgtcttccaagtgcaacttcaatatggtggcctctgcatcagtctggggtccatgagtgattatgtggagcacatgcattggatatgtgtcatgagcaagaaataaacttttgctgtattaagacactaggatttcgggggggcaatttgttactataatataacctaacttttcctgactgatacaccagggtaagaaattcagaatttaccctggaggtggaaagtagcttgtcttagtcagtctggggggactataggaaaataccatgaactggatggcttataaacaaaagacatttatttctcacagttctagaggctggaagtctaagatcagggtgccagcatagttgggctctggtgagagccctcttctgggttgcagactaccagcttccattgtgcctcacgtggtgggaagagagctagctgggtctttagcctcttcttataagggcactaatcccattcatgagggctctactctcataaccgaattacctcccaaaggccccacttccaaatagcatcacattggggttagaatgtcagcctacaaattttggtggtcacaagcttccagtccgttgcataacccttgacaggttttaagcaggtgagtaatgttgtcagatttgtcagacaactgccatccagattgtccctatctgtttgtaacagtggtgccattagccattgtctcctctcaggagggtttgagcttgttcagttcagctcccatatttcttgttatctttcccttaccaagtacagaggcccagagctttcttgtcaccactgctctgggcccagagccccattcccctgctatgagcttataggttttgtcctgcagcattatgtaggtatcagcaacctggagtcacgggacaggttcatctcgaagttatatggtatgagtgggcatctctccagcttggcaggcatcaatgtgttcactgctaatggagtgacatatttaccagctgcccacagtgaaacaaagtgtgtagatgaatttggtgcaggaataggcggttctctctctatttggtgcaggaactggcggttctctctctggttatggctgagagatctgtgacaatgactcaagtctcatcctgctccttgttgctcaaacaatgtcccttgaaacccttctttgctggttccattcacctgtctccactgagcttcaggtcctcttcctttttggtaaactaccctacatcagctcccaggctggcagggctcttggggtgaccctcccttcactttcttcttctcctttcctctggtctcctactcttttgagaaaattcttctttctccttttttggcttcctcaatagtacttccttctttctctctaccagttcctctgttctctcgttctttagcagaagacttgatgacctatttaatctagagtctggatcatcagcaattaaaacaagccaaaaaagaaaaaagatcatttccttttccttaagcggtcaggagcgctcagccttcaaactgcataatacagttggggcaaaaattgtggcaggtaggcaaagaaagggaagcaactacaaaacagctcagctttgatcctaacacagttttagcctccacagcctgctacatgcgtaatagcaagacttggcttcccgtgaaacaagatcacctgctctaaatgccttaggctttataccatttacagagtctctcagtcctgggtttcattcttatttaaatgtaagttctttctcttcccttttctctctcccaagttcctgctccctcagactcctgtctccggggtccaccacacaggaggaaagaattatttaaaagcagagcctctttacctaaagaggtcatacttctctttaggatgattttaacctttcttctccagaccaggctctggtctttggctttgcacaaccaaaagacctttagaaagatttttctctcctctgaaagagcaattttctcccaaagatgaattcttctgctagcccttttagcaatgagcacacgtagcaatatgtttgtgtctccaccacgttttatttctaatgttattattattattttgaatagctaatacatatatctagtttaaaattcaaaagcaacaaaaggatatacacagaaaaatctccttttgccctgcctgccagctacctagtattctccccaggggtgaccagtgttaccagtttcttatatacccttacaaaagtattttacgtaagtacaagcaaatacatatatcttcattttatttatttatttgtttgtttatttattttgagacagagtctctctctgtcgcccaggctggagtcagtggcgtgatctcggctcactgcaagctctgccccctgggttcacaccattctcctccctcagcctcccgagtagctgggactacaggcgcccgccaccacgcccggctaattttttgtatttttagtagagacagggtttcaccgtattagccaggatggtctccatctcctcaccttgtgatctgcccacctcggcctcccaaagtgctggtagtacaggtgtgaaccaccgcacccggccatttatttatttttgagacagggtctcgctatgtcacccagtctagagtgcagtggcacaacagtcactgcatcctcaacttcctgggctcaagtgatccttccacctagtccctgggtatctgggagtaggcgtgcgccacgatgcctggctaatttttgtattttttatagagacgggatattactgtgtttcccaggctggtctcaaattcctggcctcaagtggtcctcccacctcagtctcccaaagtgctgagattatgggcataagccaccatgcctagctcatgtatctattctttcccctctttatttttaacacatatgctgatattccatacacataaaaatatagatatagcttgagaatgcccccattttactacataaggatttccactttctttgtttataatggaatggcattctactgtatgcatgtattatgatttatttaaataaatttatttaaataatcttcttttggtgaacctttaggtgatttccattattttgctattgcaagcaatgattaataacttgtaaatatgccattttgcccatttgagtacatctgtaggaaaaattcctgggggtggaactgctggatcatagagaatagcggttccaattgtcctttttcatcttgcatcaatttacactctaactagacatcaagaaattctgttttcccacacagtgctttacatgatttccagaaaaatccttctggggtcatgagggaattgtttggagggagaggacttagagatacctatgagagagatggtgagttctcggtaaagtggggctgggggagatctactctcttcgggggtcaaatgagcctttttagaggaagatattttgaattgggtcttaagaaatcaagagctcaccaagtaagagcgggaggggaaggctatgtgcctgtgctggcttttcttgggagtttaatctgtttaatctgaagagattttctttttttgagaagaaaaacattgtatgcctgaggatataccttgcagaaattacctataggagtaaggagccaaaagaaaacgtgatgtatatatgcacttgaatattatttagccattaaaaagaatgaaattttgtcatttgcagcaacatgggtggaactgaaagtcattatgttaagtgaaataagccaggcacagaaagacaaatactgcatgttcccactcatctgtgagagtgaaaaccatgggtctcgaggatgtagaaagtagaattgtggctggggagggtaaggaggaagagaggatgaagagaagttggctgaaggctacaaaaatgcagtcagataaaataaataagttctaggctgggctcggtggcttatgcctgtaatcccagcactttgggaggctgaggcaggtggatcacctgaggtcaggagttcgagaccagtctggccaacgtggtgaaaccccatctctactaaaaatacaacaacaaaaaaaaaattagctggccgtggtggcggaaatctgtagtcccagctactcaggaggctgagacaggagaatcgcttgaacccagaaggtagaggctgcagtgagccaagatcgtgccactgcactccagcctgggcaaaacagaatgagactccatctcaaaaaaagaaaaagaaaaaaaggaataagttctagaatttgatagtacagtaaattataattaacaataatttattgtatatttcaaaatagctagaacagaagatttgtaatgttcccaacacaaaaaagagaaatgtttgaggcaatagagatccaaattaccctgattcaatcattacacattgtatatgcatgtgtcaaaatatcatttgtaccccaaaatatgtacaactattatttatcaattaaaaaaaagagtaagaaacaggaaatcatttgataaaggtcaagtaatcattatatatatactctacggaaaagaaaagtatgataattaatagtaactataataatagtagctataatttattaagacctaccatgtgtcaggcattaggttaaatattacacatacattttaaaaagcccatttaatccacataccaattctctgcataaggcactataatttccagtttgcaaatgagaaaatcgggaatcaaagatgataagtaacttcccaaagttaacctaataaggaattttcagagccaggcttccacgaaggtatgtgacccctgaaacctgtactcttacttgctagaataaccccttccattagctcattgaactctcaagaattctaggggaggttccctggagatgaagtgattacaggtgagaaaactgaggctcacccagatgtggtggctcccgtctgtaatcccagcactttgagaggccaaggcaggcagatcacttgaggtcaggagttcgagaccagcctggccaacatggcgaaaccccatctctactaaagatagaaaaattaggtgggtgtgttggtgtgcacctgtaatctcagctactcaggaggctgaggcaggagaatcacttgaacctgggatgtggaagttgcagtgagccaagattgcgtcactgcactccagcctgggtaacagagtgagaccctgtctcaaaacaaaacaaaaaaatgaaacaaaacaaaaagccagaggctcaggaggttaaatgacttgttcagaaaaagtataaagaacatatggcaacatggaaaaatgtttgcttaataatgtaaggaggaaaaaatgatagtctataattgcttaaatgtgatgatcacaactgtgtaaaaatagaaacatctgtgggtgtgctgactacccatccggagtattctagggcagtcctcggtttacagtgtcagactgttgtcagtcctatatctggtgctatgctctgatttcagggaacttggggaaatatggctactttacttaaagataaggactgtattgaatgagaggctgaggcaggcggattacttgaggccacgagttcaaggccaaggccatcctggccaacgtggtgaaaccctgtctctactaaaaatacaaatattagctgggcgtggtggtgtgtgcctgtaatctcagctactcaggaggctgaggcatgagaattgcttgaacccaggaggaggaggttgcagtgagccgggattgcaccactgcactccagcctgggcgacagagtgagactccttatcagaaaaaaaaaaaaaactatattgaagatatttaagtagttactgatttttttttaaatatgaaacttggaaagactaaggggtgatatctgatacaaatctagaagattgcagaagcagacattttgagaaggtatcttagccttactaattaacgtaaattgatatcaacatcttgcctactcgttaaaaggctactccagttattggatttctgtggtgattgttttttaaaggttagccttgaccaattctattacaagttttttttttttcccagcagcataagtgagcagaatcaagagaagagactgatatttatttcaaatagtaaaagtaaaaaatatcaattagtttcttcagaaaggttacttggaatttctttatttgatcatctgttcatcctgccttcatgttagttcatctctttattcatttcattcatccattcattcattcaacatttactagtctcctaatgtataccaagttctgtgttgggcactgggagcacaatagtgaacaagacttggtccctgcccatgagggattcactgatagagctagaaacataaacaggtaagtataccacagtgtgataagtgtcagtgcaattcattcaattcagtgtgtattgagggtctgatctgtccagggtgctgtgctgggcattttcacaggaagcagagattgagatatctggccctgccctcagggagctcgaagtctagtgtgggagatggtaaacaacccagtaatgaaatcattacaaataaccatcacttacaagggaattaagcagagttctggagtggagaataacgagacaggggagcctatttcagcagaatggtccagaaagtactatgatggaggcatgtgcaaggaactgtgaaaccacggaggggctgctaatgtaatacaccctggaggagacagggaaggctttgcaaggagggtcctctaaaactgagcctgaaaaaataaaggagagttaaacagggggaaagtattaggacacgcagtcccaagaaagagagctggggtgccaaggtttgaaggttttggggtgatacaaagcatgacctgacaggaaccagcaggattctgtggcataggggcatggggttcaggtgggaaggggatgagatgaggctggagggttaaagcaaggccagatcatgtgtggccaccaacgccaggctaaagaagctcagagcttgtctggattagtgataaaaagtagagcttaagagccgtgactgttggcaccggggattcccagagcctttcgtgggtctcatgaagccagactgcatctgctgtattaatattttatgccatgatcaagtagtatactttaaaagagagatcacagcttgctgctgaagatttaactgcttttcttcttcagctctagggaaaaacaggcttgaaagtctttctggggtacttcaccttaaactgtttaaaggctcctcccccatccctacagggggacatgtagggcatctggagacaagaaagagggacaggtatacaaacaaatttgatataagatttctagccagctaagactttggagaatggctgtgtgagaagctgagcgtgagtctggactaagcacagaggaagctggacagctccctgagaccccaagggggctcacctagagacctggatctgcagggtcatctggctgaggtcaaggtcaaagcagcaagactgcgccagggagaaagcaaaactctagactgcctgcttggtgtggcaggatgaaccccttctcgctgggactgcctcagcctcagaatttggggagcattcaggaggagaggaaatctccatcggggaaacgtgcttcttgctcattaggtattgatttctcaagttggtggttttggtttgagaaaaaattaagtgaagtgattgcatttgcactgtgcatttttgaagacattcttataaattccagatgtaaagtaagacaacctagagtgacttgacctaagagctaacgttttgaaaggcaattgaatggatcttatgagacaaatgctctctggttctccctgggacaggaaacctgtgctggggctagtgcagcacaaccaggggctggaaaagctcctggttttatgagccaggtataatctctcttggagttactttgttctattgtcccagtttgccgatgacacaatggagactcagaggagtggatgacttgcccagggtcatttgcaaggtagaggagacacggggtggaactcggatgttctacttccctgggcaaagctattagaacttcacagcaaagtctgctactgctgacaacagtgatgagagaggagaaaaaccaggaaaaagaaacagaagtgcaaaagaacagggagaagggaatgtaagaaggagaaagtggaaggggaggaggagaaaggagggagatcaactttggactgaaactttaatccaatcatcagtttttttgtttgtttgtctgtttgtttgttttaagtttctctaaattcctaagaaggtaatgcattgctggcccgattgtgtttcaactccaagaaacagcacaacatttgaaaagcccattgttcggtgttgtgataatataactctctgtaaatggtgcagtccactgtacaaagtactgccccctcccatcccactggtggcctgcggggacagctgaatgccttctggtccgctgagcccagaagagtggggctgggctttcagaaacagctgggctgattcatctagaacaaaagccagctcttcctgctaaatccctggcaggcatgggctgttagggctgtgggcccctgtgcccctccacaggaaacgtcttgattttgctccaacagtgtcagtctcctgtgtgagcctgcgacagcttcctcctgcccagtgccttcattcagcctggcatgctcccagccccacatgaaaggcagtggctttggagcaaaacctgggttccagtcccagctctgccattccctagttgtgaaatgtaaataagagatttcaccttgctgtgcctcagtttctcgatctatgaactgggagtgagagtagttccaatctgagaaattttcgtcagctttggaggagataatgcccagagcaggcatccatgaatatggtttcctcccgttttttataagacccatccatcttgccatatggcttggtctcccgtaactcagtggatgtaccctgtatccctgacacactggctcaagctcattcaccttaaacacctccacgcccgtacctagggggttcccatgatgacaccagccactgttgacagagccctttatatgcctgaggccttgacacagagaattcatttaatttccccataattctttgagtggatattatcatcagaggaagaaaccaaggctcagagaggttgagtaactcagggtgtcctgtccttcaaggcctctgagtacaaaaatagcaccatctccaagatttttttggtgtgggtgtgtttaagggattttatgaattactttttgtttctaaagcacagcagttcacaatctttctgagagtagttccacatttcttgaacagctccaaataccttccatacaaagaaacaacgagctgtagtcaaccattatatgaagtgtacagagaggggcctaacatcagatcctaacgttgtcgagatgaaattaaataattcttgatcctgagaagggagcatggaaaagaccttacctttcccttggccttctttcactctggctatagaaagaatctgggctttggagacagacctggattcaaatcccagctctaccactcacctagctgtggaagcttaagcagattacttatcctttttgagcctatttattttatttgtaaaattggagacaagaatacctaacttagagggcaattgtcaagcttaattgaaataataaagtgaccggcatagagtaagcactcagaatgtggcagttataattatgcttttagttattattatgcatgccactgtcatagggccagctctgttaagctgtggaggaagaacctccaggcagttttgctctttcctgaaaaatctaacctgggaggctggctagctgggaaatcctctgctgtgtaacagtgaagtcactgatgcttatgctgtttagcatcttactggcatttattgggcataattacagaatcatagctgctaggaatccaagtcttagggctgagctggcagtgcttatatggaacacaaagttttaagttctcattaaaatagtgggacaaacacattcctgcctggggcattcagaacatgtctagaataatggctcttgaaattcaaagagcaaccctctcttgagtcctcccgtagtgtccccaatcactctatctgaccaaacccatctgtggtcactttcctcattcaccaattcattaatccaataaaaacgtgctaaacatctgctctgtgccaagcactatttgacactgggatgatgtcggaaaaccaagcaaacacattttctccttccactgagctgccagtctaatgagatatacacataaatggacaatctgaatgcagtgagtcgaatgggggaagcccaggttttgagcagtggtgtgctggtaaatgttaaacgaaaggctcttggtggagggagaaggaaaaccctgatttatagcctttcctgatctccatggtgtaaatattcccaccgtggggactgggctaccagcatgatgtcactgagtgtggagttgcgagtagaaatgcaattgcacacaattatacagtatttctaccatatagataaatggtgaaaataagagcacagataatagtgaaatatagtaaaataattatgaagtactaagttttgagaatttattacctctatttatgtattagtcattttcacactgctataaagacatacctgagactgggtaatttatgaaggaaagaggtttaattgactcacagtcctacatggctgggaggcctcaggaaacttacaatcatggtggaaagggaagcaggcaagtcttacgtggtggcaggagagagagtgtgtgaaggaggaactgccaaacactcctaaaagaatcaggtctcggctgggcaagatggctcacgcctgtaatcccagcactttggtaggctgaggcaggtggatcacctgaggtcgggagttcgagaccagcctgaccaatatggagaaaccccgtctctactaaaaatacaaaattagccgggcgttgttgcgggtgcctgtaatcccagctactaggaggctgaagcagcagaatcgcttgaacctgggaggtggaggttgcggtgaaccgagattgcgccattgcactccagcctaggaacgagagggaaactccatctcaaaaaaaaaaaaaaaaaaaaatcaggtctcatgagaactcaccatcatgagaacggcatgggggaaactgcccccatgatccaatcacctcccttccaccagattccttccttgacacatggggattatggggattacaattcgagatgagatttgggtgggaacacagagccagaccatatcaatttataatttacttaattataagtttatatagattgttattgaaggctgtgcttaatacagccttaatacagctgggtgtaagaatgcatggaaatttggccaggtgtgatggcttactcctataatcccagcactttcaaaggctgaggtgggaggatctcttgagcccaaaagtttaagaccagtctggtaacatagagagacttcatctctacaaataacataaaaattagccaggcctggtgggatgtacctgtggtcccacctacttgggaggctaaggcaggaggattgcttgagcccagaggtcaaggctgcaggaagccatgtttgtgccactgactccagcctgggtgacagtgaaatcttgtctcaaaaaaatccacaaaaattcatggaaattgagcaatcagttcgtaagaaaacaacactaaacacactaaatcagttcttaagaacacaacactagcacaacactaaaggggaccgaggctggagaaaataacagtctcctttccttcttccagctctgtctttctctgacctccacacctttgcttattctgtgctcttagcagaagatgctgttcccttcctcacctccactcttattctttccatcctttcaaggctgactgaatccaagccgttgtctctgcttggcttcccctccccttttctctgggaagtgcaccccctccacccacaggttacagtgggagcagccaggtttgtgcagtaggaccctgtcactcgggccagagttaattagataaagggtaggcatctgatccaacttagaatgtggactacaaacaaagattccagcttgctgctggtaaaagccattttctggaaagcagaaatgcttgtgtgatgtgagcagacaggcagagatgaaagatgggggagagagtactttctgggttccctttagtactcaggtcctgcttgtggtctgatcctgaggcccagctgcacccctgccctagtgttccatgggatatttcaggatctcctgagagtgctctctcaagtaatcccttgtatgaaatccctgtctcatcctctgcttctagggacaaactacaaggcattcgatgctcaacaaatacttgtgctgataacttctctttctgaagccagctccaggagaggtctgtaatcagaagagcccctgaaccctgaagcctcctgggctgcccagcccaggcatctcctctgtgagttttgcgacacccttctagtcatttaacgagcctcattggctttctctgtgaatacgatggaagatggccacctcaaaatggcagccttggccttcagagatcattggtcctcacagacccagttaattaaccatgattgtcatgtctcaacttccagctccaaattctaatagtccagcttttttctgccgtccactcctcatgctgtcaactgtgttgtgggggaaggttacagtacaaacctgggtgcaagtgagggccatccccttgggtgggaagaggcgttctcagaggagagagcaggtacccccagattgtctaatgcctggcctgtgtgtggccttcatttctccccagcctcactctgggaaggaggtggtcttctggcaaaagaagatatcaaagttcttccatcagaggagatccttatcagcaagacattcactctgaggtgaggatccaggacaaacaggccttaccttacctagatccaatggggggagaagtacaaagaggtatctagaaaggaatgaagacaggataccaagaagacttctaggcatccatgaaaggcagacttgatatatcctgccagctataaaatacacatgttgagtcataaagcaaagcaccaggagatttctagaagtgttcctagaggagcactcccatgtaagtattggttatcatcatcacaatcatcatcaatcaatcatcatcatcattatcttcattatcatttctaatgattcctggtgataccctgttcccatgttcctctccagccaccaaatggagcaattacagggttatgggtaggcatctgacccagcttagaatatggaaccttagatctagcttagaatgtgaacccttttgctctcctggcctcagtttctccatctctaaagggaggagttggagcagacattctccaatgtttcctccatcgtgatgtggtattctccagttctatggggacacagattcagagttccacctccctttgtctgagagcagttgctggggctggaaatgatatgttagataattccaaggcatgtgtatgccggggcttgtaatcaaagattccagagccaaataagcctgtgtttttgcttttctccccagcagccttgcattgggccccaggcagcctctggagaaagcagagagtagcagagatggtgtgagcctccctgcggggtggataccttgcttgtattctcagagaaagtggaactgggcagaatttcccaagccaggaaaggtggcagagtgtgacataagacattgagcaaagaagcgagggccaaggactcaggcatagaagagtagactgcacagtatcagtagtgtgacctccagagagtacttaaccctttctgtgggcttggcctgctcatctgaaaaatacacatggtaatgcctcccttaggaggccaggtagggaggtgagaattaaagtcggtaatacgtgggaagcccagagcatggcatgaggcattcaagaaatggttcttgtatttactggtgttgaacaaagagagaatggcaggaggaagagccagggtgagattccctgggtcctgtggcttccctggctgctattcaatggaaaaaccagggagtgagcactgtgctcttggcttctgtgctacttaaacaacagccttttctgctctgatccccagcacccggcaattactgactctagtacattttaccttgtgttaagagggagctttaccctggctgaacatggggctgctgccagcacccaggctgggaatggacatctctgtcatgtggtgcagtctcctgtggagtgtgtgaatccttccaaaccggagtcacgcggcaactccaaaagtcctgggaactcatgtgtgcaccaggactgctgggaggccgtcttatgccttgctgcattataaacggctatcgtctcaaatgcatatgagatgttgttgaaatcaacaaagtattacatttgcttaaaattgaccttgcactcatctttctacccaatgtggatttcctcaatctcctaaaacagtatctgccatgacactaataagaacatcccttccgtttatgcagaagccacggtccctgtcattgtgctgagagtctttttctcactgagtcttctcaaccgccccatgaagcggcaattcaggatgcccatttgacaaacgaggaaacggagacttagacatgtgagctcgcttgcccaaagttacaggactagtcgatgtctggggttccaaaccaggccttctgactccgaggcgcctgcttaatggtccactttaaggaccagggatgcacttggcattttcgttacttcattcggaatgagctgggaatcgctcttcctccttattcccttccgtgggagggaatctcccctgctttgcatgcagcctatgtcactcttcgagggctttgcctcctgaagtccgttctctccagggctgaaatctgcctccgctggtgctagttgagcattgctcgcttgcccgtcccatctgagctctttggccccagcccagctcaggagctgccctgggtctcctccccgaccctaggcctcttcagatctcccctccgtgctccgggcctcagtttcctccaggggaaagcagagggcttggtttggtgccttcctgcgaggtgaagcgaggggtccccctggacgaaggcgagcttggagccacccgcccagcagccgacgggagggcctggcgctcctcccccacccgcctgcccggccgccccgccccgagggcggctcccgcccgcgccctgcccaccccggccgcgcgcaccacaacgcccccgccccgccgcccggaaccagctgagcgcagctggacccagcagccgctgtctccagtgccgcagcagcaggtaggggaggcgcgcggccccggccccgggcatctgggggtcccgggctgatttgagtccttcctctcccttccttcccggtcctatctcgcccgcgcctggagctcggcccggccgcgggggcatcgctggaaaagggcttcctcgctcacttttcccgtcttccaagggaccaaagagtgtggatgggagttgggggatggggagacgccggagcaggagaggagaggggccaggcctccaccccgtgattccactgtgctgctagcacctgagctaataacctcgaccccgcccccgggatgggggaactggcccggggtcacccctgcacttgggttgtctgacccgggcatgcaggggaccaccagctacggtctgggcggtgactctgctggggagtccactcagaggacccttgcctcctggacgatacctgtgcctgctctcctctccagctgcttcctctttctggggactgttagaaagttcttccttacactgtctgaaatcttcaggcgcctgctacctgtaggtgctggcttctccccggccctgcagtgttcccttccctgactcacacggaagcttcttctggagttgaagacagtgattggaaccccttctccctgagcccccatgtcttctggggtccagccccccagaacctaaataacagcaacttccctctggtccagtgcaggctggctggtctgggcagtgcccagggggaagccccagtccttggaaggctgggggctgggggtgtgggtgagcaggagacattggctttcttcctagctccttgtctgcccagacatctgtcgctttatcctgtcttcacaccctcctcagagcatggaagggagctttaaaacacccagaactcattctgggctgtcctgagggtaattggactttgtggaaggcggggcctctggggaggtgcctttcgcttttgtttggcatctggggacttttcaaacacttaatcctgtgtgtcctgttctcccaggaccacatttctgaccagggcaccaggacctctcaccgctctgccgtttacagcgaccatagcttgctagaatcttaccccatctccatttcctccatttcacagttgagaaaagtcaaggacccagagagtttatgatgggctaattgtcacacagtgaggcagggtagggctgagacccaattccggtctgccgtttgcggactccttgctgggagggactctagcctccttcttgggtgttccgtttactaaagggacaagcattccctgtacatacacacttgggggtgctggttggtgtttcttggggctgttaagggggagaggcttggaaacagaggaggaaggatgggggtgggaacggtcggctttcagctcctttgaaactccatttttctttctggggccatgctatttataaatgccagggaaattgtaaacagccaggggagcttgggttggcactcggtgagttacacagcagcaaagaaggtttctgtgtgaatcaggggaggaaagtttactccagaattttccacagtccttttattagggactaacatgagcctggaaacaggctgctcccaggaggggtggctgcagggtttgccccgcatggcatttccttcctccccgcctccctcctttcagcacttctctgggcctgtgttctgtgccttgccctgcgaggggccaaagagccttggaagaggacagagctctctgtcctcaagatgcttgccatctatactgtttgacacttttgtgccatattaagagtgacttcagcctgcaagaggagtgactaattttgtctaggtgagccagacctcagaatgaataatcatttaccaggagaaacaggagttgggggaaaagacattctgggaagcaggaaccactagtgcaaaggcactgagattttctgagccatccatgtggctagagtggaggatgggagaagggcggggtggtgggaggttgagaatctaaatgaaaatggaactagattataagctaagggtttggacctcatcctgaaggcaatgaagagctgagaaagggttttgacagagcagtgatttttaaaaactcgttattctgaatggctgatgtaggggatgcattgaacgaggctgatctggaggcaggaaggccctgaggaggctgttgcatgattcaagtgaagtagattgcaggtctgaactagagcagtggccactgggatgggtcagagcagcagattctggaagcccagctgaaggtctcagaacctgctataaatttcatctaaaagcagacaacaggctagacctactggagaaggttgctaaggtattcagcattgtaacttttttttctttttcatgagttttaaaacaaacaaaaattgttaaagaatccctccaagcccgcctctttccccagaggtcgccactgttaacaatggtgtgtgcactcctgccaaacacgttgattggatgccttcacttttagccatccagtgacagtgggtcactttcccctactccatgtgaatagtttgggtcatttgtgatgtgggtcatagagatgatttctgcttggtctatggtacgttgctgagacactgagctctggttttctttaagaaaacttttacatcctgtgtctgcggcctctgggtgtgtatatttgcttatcagagaccacaggtgtgagagaagttagaagcactgacttggaaatggacccccagtcttggttctttgggtgaccttgggcaaatcctatctctctgagcctctggttcctcatgtgtaaaatggagagatgttggtttgcatgataataataaaaagctatcttttaactgggcatggtggctcacacctgcagttccagcattttgggaggccgagttgggttgatggcttaagccaggagtttgagaccagcctggtcaacatggtgaaaccctgtctctactgaaaatacgtgctgggatgctcctgtaatcctagctacttgggaggctgaggtatgagaattgcttaaaccctggagacggaggttacagtaagctgaaatcacgccactgcactccagcctggatgacagaacaatactgtctcaaaacaaaaaaagaaaagacaaaaaaagctatcttttaatataccaagcactggaacattaattactttattgattccttgcaaccattcctctgaggtagatactagtatcttcttttacagatgaggaaactgagtccgaggctgaataacatgccccgggttgtgtggctattgggtgatggtgcaaggattccagaggtctgacgacagagccatagctattaatgacagcactaaacattctcttgaaaattctttctagtcctggtattaggagaactggtaagggagtttgttatgcttttatgaggggtgggtgtcggtgtgcagagcttggagagctcagccctgcagcagagaggcctggaggggcctcccggggctgtttgtaaactcatgctttcctgtgccatccgcaggaccctcagtgcaggtcaatctcccctccatttcagggaatccaggctccaaaaggacacaggacttgcccagcaaggtcatgtggtgaggtgagagcccagccaggactggtccccccttttcatcaatcaagcttatgctctggaaatctatctggcgaagccaggaaaactggacactctcctgctccttggttattccctgagaaaatgccagcagaagcagagaaaagcacgtcccaggggttatgcattttggggaggaagggaaaaaaagagaccagtgtttaggcagccgggggatgttaagtaaaaatatctcctcgctttcaacggagtgagcgtgtgtcatatttcagcctgatgtggtttgtgaagttggagaccacaggcaggctcagttcctgctgctggccagcttccccttccctctgtccctcccctgccatatgcctgctctcgtctgccctgcctgggaccacatcagcaatttaagaatagggcagagaaaagcagtgggtgttgtgggcaagggtaggcagctgaaggcctgggcttgggtcctggctttgccagtgacaaagtactgggtgacttgggctaatgcatgcctttctctgggccccagtgtccattctgcactgtagggtggacagcataatgtcagccttcccagctctgatggcctctgagttggagggctttgtgctccccacatgtacttgggtccggcatgtctgagacacaaagtgagcccgcagtggtgcaactggtgattcagctactgttcttgaatttaatcttttcggactgaattgattgccccattttgcagataagggagttgaggcctaggatttgttgatgtatcccattccctgctctacaagcaacaataataagggccaccatatgtaacacacttactatgtatgttcaccttttgctttcactatctgctttaatcttttaacagatctacgaggggagagatagtgactccattttacagatgaggaaactgaggctcagtttagaaaaatgaaaggacttacgttctcttctttgagtctcacaatagtcctggggttgtcattatgtgacccattttaccagtgaggaaactcaggcctggagacgtgagctcctttgcccaggggtccccagggcccacacacagcctgtcaggttccttcccaggccctcctgctcctccctcctcccttgcttgctctgcctcatggggagcctcttcacctcttgcattcagtgcctgggttaagggatgagaacagttttcttcctgggctataaagtatccctgaaattgactcttcccaagagtgatccagaaaggctttaagccatggagcctcgcagggaactccagtgaaggggtcgcaccagtgggagtggattcgtttattctgctgagctggctaagcaaacagtcctgttattttccaacctcaataagaatatcatcagagccaagcttatttgccaagcaaagtatatatattctacatatgtgagccttcagggtggggcttggcccttaatttccctgctacagagactgtggctgagctgggttttggtgggtactaagtaaatactagttaacttgttgggtgtgtgttgatgatgtgggtggcatatgtacttttttctccccacctccaaggaccttttccccccacccttattatttctattacacttgtgatagaaaatttaggaaataaaaaagtatatatataaaaaagaagtgttcataactaaccagagaaaatcactgccaacacctgggtgcccttccttcctgatattttcagtgcatttttttttacccccacacaattatcctatatttataattgtctgttctgactttctgttttttctcaacattatatcgtaagtatttttctcatgttattaaggattctttttaaatttaatttttaaaagttttaaaagcatactatacctaagtagataaatgtttattctaatttaaatcttttattccaatagtcctagggattaaaaaatgaaataatgctttttatttattaacaaaaaggctgagagaaacaggatttgcccaagatcacccccaaagaaccaagactggggctccccagggctgtagtttgcatccataaatacagagagaataatgtttataatcttgggtataaaaacttctggtgaaaaggttgatcaaatgctagctgtatttctcccccttccatggctttctactgagtctctctctcctacaggaccctactttgctccataattaagcagcaaagtatttcaagagctgttcagattctagaaactcatagcagatgaaatcgacagataagtcagatatcgaatatagacattaaaagatctgggcactaggctgtaccctgttattgtcagtggctctttagtccttaaacaagggtcttgcctcctactttttttttgttatggtagaaataaatgcccacccgagttttcatcactcactattattctatctttggtgtgcctgtaccatgttcccttaacaatcctcaattatgaaacatttaggcagtttataaacaatactgcaatgaacaacctagtgcatactttttttgtgtgttcttcttttattatttcctagaagtgagccctagaaatggagttcctgagtcaaaatgacacattttatagctttttcttgttaaaaaaaaaattcagtgacacttgtgaaaacacggtaaggaagtctttattcaggaacattgccttgggcatagggaccactgcaacagggtcctacagtgagggagagagtttgggctcaactcctaatacagcatgggcgagtgggaattgatagctgcagagcagggtaggggtcagcggatggaaaattactaagaggaagctcaggaataagggatattcttgctaaaccgacctaacaaaattattgatgaagacaaaccagggtgattcaaacatcagtgggggcatggtggaggatgaggagcctgatcagatatcaaggatgaggggttctggctaaacagacttagcaggattcttttgctaaaactggattttacaaggaagtgcacaggtaggcctaggagaaggttcagaagcctggctaaagtttggccaagcaaataatctgtgtcatgctaaattttgccaaatttctgctcataaaggttacagtagtccttattcctaccagccatccgtgagaatggcagcattcttcaggagcatctgaagctggttataaaaagctcagctgtccttttatagaatagagtacagcgaccattttcctgaaacgttacatttcattcattcatttggcaaatacacttgcacaattcagcagcaataaagcataacaagttaagatcccaggccgaagaagtggagagaacttggttctccttctggtttatgttttgcacttgccctaagaccttgaggacatcacctcactgagtttcatttttctcagctatacagttagggcttcaatacccacttcacagaattctacaaagtacctaacacaatgcttggccagtgcaatcatgtggatgctgggaatttgtattatctcatctgactccaaagagccctggaaaggaagcaggtagggacagatccttcccatttcatggactcagagaagaaacggccatgtttcttggtgtcctgagcttcacttcaggaactggtagtccaaaggaactgtatcgttcagaacggaggtaaaacaggcttttgtgggctagcctgtatccatccccctcccacctcccctcccaccacagtacctgtttctcttggaaggcaagttcccagttccagtggcagccagaattctttctatgctcttttagaaggtgggagatgcctgcctagactgttcagtggtcttaaaaaagagaccataaaattcatggttgcataaaatatagttttcatagatttaaattgcattttaaatgcactaaggcttcatctttgagcttttcagaaatgtgggatttcagactccatctttagggttgccttatttagcaaataaaaaacagtgtgccagttaagcatgagtatggcccttggaatgtttggggcataattataccaagacatcttattgtctttctgacatttagatttaactgggcatctcatgttttatctggcaaccctacccaccttgggtctactgaatccaaatctggattttcacaagatccccatggaattcgtgtgcgaattcaagtgtgagaagcattgcattgggagccttgccatcaaagccctgaatgaatcctttttgtaacaaatctgttggtaaaatataatgcactatttataaagagcctgattattcccaaatcaaccatttgcacacatctgtgtgttcatgtgttaggttttcttaatacaggctacccttgcactgttgtcagttgaagggaagaattccttgctttggtaagaagccctagcccctctcaaggacctattttcctcatctgtaaaatgggctacatccttagcatccgtgccagcctgtggtgaccagctgaggtggccccaaggggatgcatggctagagcccacgccaggtccctcctcagcctcctcacaaaggaccgaatgacttggctctgtgatcccatcccccagagactttggtgtgactgtggtgacccttggcatagcgcacccccccgactgcctcctcatctcaaaactttccaaaccatgacttttatagcagggctttaggaatcgcctggctctaccctctcacttcatggctacagatacttgtgccctgagagagcaagtgaatttcccaaagccaacagcaagccctctgattgctgctctaccaaaccaaaatgatttcagttctcatgaaacctaaggcctgactaaggaagattaagaaacctggtggtggtcgggtcctgtagtggggtgggaggaggggggagggatagtattaggagatatacctaatgtaaatgacgagttaatgagtgcagcacaccaacatggcacatgtatacatatgtaacaaacctgcaggttgtgcacatgtaccctagaacttaaagtataataaaaaaaaaagaaagaaagaaacctggtggtggtcatacgcctagtttgtcttggttgtgtggtcttgggtaagtcatttctctctctaacctattccctgcccccacccctccataatatggggaatacacattttcctgttcccctaggtctcctttctacctggttaaggttttattttaagatccagtggtagatcttggtctgtcaattggtcctagagtggaatgctttatgaaatcactggtacatgtgttaggtcagagacttaataccatgacatcatgaaagatgtctttagaccctttctctcctcattgctaacaaagattttatgaactgtgtttcagctggacaaaaaagatgttctagagcattctaagatcgcctggggcttttgttaaaatgcagattctggttccacaagtctggggtggggcctgaggctctgcatttctagtgatgctgatgtagctggtccagggatcacactttcagttgcaagatttgaaaacaatctgttattagtgtagaatcaatacttatgagataagggacttaagaggcaagtcccttgttcagggctaaagacccagtgacagtaatagggtctagcctggagcccagatcttttaatgtcttgtctttgacatctgacttatctgtctattttatctgcagctatgagtttctagaatctgaacagcccttaaaatactttgctgcttaattatgtagcaaagtaggttcttctttaggaaagagagtgactcagtagaaagccattggaagggggagaaatacagctagcatttgatcaaccctttcaccagaagtttttatacttgagattataaacattctttctgtatttatggatgcaaactacagtcctggggaggccccagtctgtttttgtatgcctctgagctaagaatggttttatagttttaaagtgttgttaaaaaacaacaataacaaacaaacaaggaagaatatgcaacagagagggtgtgtagcctatggagcctaaaatatttacggtctggcccttttacagaaaaagtttgctgacccatgatctagagtacccaaagatttgcatgttcttttttttttttttctagtcagcaagaggcccagccttatagctttgaaatatagtgaggtcaagacgtaggggaggcagcctgcgttggtgggaactgcccagacatcttagctgtgtgaccctgagcacattacttcacctctctgagcttgtgtcctagcttcacaaaatgaggacaaagattgctgcctggtagagttattgcaatgatgagacatgcctgtagagtttaacgcttggaaggtgcacagaaaatgataactattgttattaggggtggccatttgaacgcttatggcattaatggacagatatcatgttactcccatcaggtctgaaggccctcccaatgaactgggagcagtcttttaggagagaaaaatactctgctccagtatccccccatcccacctccagagcagaaagctcctttttagccagctagacagacagggttccatggtggcttgcagactttcatcgggcgagctctctccccaaagactggcctttccacagctgagactattagaaggcgtcttctgttcctatgtcctaggatgtgattcagcaaacaggcacgtagtgagagccccaggctgggattgtgagtgctggaatgaaacccttctctttatggctccatctggagtgtgtgggtggtggactagaatcagtggttttgctgaccttgtttttaagctgctgcagccttaaggtccaaaatggaaaacagaccaacttggagttagctggggctaattctaaacctggctgagtttgaaaactcagctcctggggtgtgtctgaatctcagggagagtgtaatgcttttcttgcccatagatggcagcatctgcactctttgccggctctgtgaatgtgtgtgtgcacgtgcacgtatgtgttacacacgtgtgcacgcatgggagtcatagtttcttactttggtaaatcttgagctgcggtggtcccagccctaggccaggctctgggatacatgggagcaattggggaggctgacttgcaaatagactattacagtagagtgtgaccgggcagattagggggtgtggaggtctgtacggagactacacggaggactcaggaacagagtgccattgcatctggctggagcctggtggggtatagtggaagacaggaagccatgagggccaaggctcaaggagttgaaggggacaggtcatgaagaatgtggagagatttgttaaggatcttggactttatctggggccatagtggagccatggtaggtctgggcagaggagtggcatggtctgggcttgctctaaggaggatgcattgtaggagggagaggttgcaggaggatcagttaggaaggttctgcagtcatgcaggcaagaggtgatggggctatggacccagatgttggcattggggtggggagaaggggggacactctggatgcagtcaggggttgaactagcaagacatggtgatacactggaggggagagtgacagagcaaaaggggtgagtggtgtgttgaggagggtgagggcctggtgtctggactggtccaccgggtggatggtggatggtggatggtagtgctgtttgccgagatgaggtgcagtaggggaggagcacattgtacttgggaacaaatgcagcaccaccatgtgcatctgaggatgagagtgcaatttggggtgtgtagaaagaaggggggctggattcgaaaggctcatcctcacacagagttgacagagtgcgggaggtcattagtcatttgcagaaacaacagaacccaactctgctttggtctgtcccttggaaccaggaagtttctgccatagtctttgagaaagacccacagaggtgggcaccaggtcctgcagcccagataagtgtctggcctctgacctctctggttttgggtaccgtgactccacttccgtggctgtgtcccgtgtcagtcacaatgcacaagtcatcaggactgtctgaaccatttactgtcagcctgagaacagggcttgtttgtgtcttaatcccaggagcctgcacggccctgccatcttcgggatcttggactctcccctcggcttagggaagctggtttaggcagagaaattttccagtgtgggcaggagccagtttgctcagcttccctctgaatgtagatgactggaattcttagtggcgaagaacggtgaagatccaagttgtccctgagaggcgggaggactgagctgcatactccacgatgagctgatgtgggatggtccttcatccactcatctagcatatgtccactggcactgccatttgcagggcacatgccatgctgaagctttagaggtgaagcagacagaatccttgcctccaaggagcttacagcctagagggagagaaagtcctatcaccagacactgataatgcagtcttgctcagcagtagtgcattagaacaataatagactgatgctgaggtacagagctgcgaatatgacatatcaacagggtgggtccccaaatcgcacatgtgcaggatgagaaagatacaatttgcaggcaaaagacttagaaatttaattattaataatcagggtaataattagagtaaacacatgccttgtgcaaaaccctgaacatgttttatctcatggtaggttctaatattatccctctttgaacagcaaaggcaactgagactccgagaagtgatgtagcttgctcaagttacacagttaagtgagggcccagtttatataacttcagagtactaacgtacagctctgaagttgactgtaaactgaattcagccatgcaatagggctgccttaaatgcaaatgggattttaggctcaattaatagaagcatgatatctctaatgaaggaggtgagagtcctgcttgccctgtcctggatagagcttgactgattgtctaattctgggtcttgtgctgtcagtagggacaggtttcatctggagcagatcagggaacagggtgagcgaaccggaaaccctggtctcaggaagagctggaggaaagggggtgcacaatttgtagaagacttgaggggcccaggatcactgtcttcaaatctccaaagagccatcaggaaagagggggacagacctgttctggctgacccaaaaggaggcagagctaataccagcaggtacaaggcataagaagagagagattttagtgcatccttaggacaattcttttacgcagccaaaccctccagcagcaggtcttgcagccttggcaggtagtgagtgcggtgttgctggatgtgtgcaagtactgattgtgtgacccctggtggaggggaggaaaggggttgaaacatcaaatggggatttgaccagatgaccttgaactccccctgaggctgacattctgtgccctttgtttacaggtagtgctcatagctctctttgtccagtgcttcggccttggtcccagcgccttcccacggagcagcactcttcaccctgcacagccttgttaggtaggtagagcaatacagacacctgtcgtcctcttaaaccccgccctggctgcccagggaagcctggaggggacttcagtggtggaagcagccgctgtagccacagtggattcagtgggagtccctgaggtcttcctaataaggctcagagtgcgtctctgctcctttcctgtccttgagagggaggtcaggcgagagtgatcttgtagggaggaggccgggactgggctcggtgcccggatgcctggctcccaccctggctgtgctggttgcttgctatgtgactttaggagagttgctttccctctcaaggccttggttgctattctgtagaagagcagagtccccataaagaggaggtgcaggaattcttcccagaggctttggagaggtgagaaaaatgggggtccatttgccaagtctctggacttgttgaccagaggaggagcacctgaggtgtgtgagtcatggggaagcggatgagtcatgcccgctggggccagctggcagggtggggcccacctgactatcagattcacaggtgacctgctgaagtaggtggggaggtggggggaggagtgcagagtcctgggctggaagccaggagactggctcacctcccagcttcagcctcggtttctccacctgtaggatgggtgccttggtctccccctacccacctaacaaagctgctgtgtggacccaacgagcttgtagatgccaaagggctttgtgaccagtgagacaggaaggatcactactagggggaatcgcccagcttccaacacccaaacagaagtgaatttctaatgagcaattgtgcaagaacccaggaaaacacccctccaacccacgccatcccttttctgccaaaaggagaaggggatgaatgaatacaggacttacgcgtctgctgtggcccagctggcttccagatggtgacatgagccacccacagccggagctgttcctctttcccaaagctcaggtgaaagggctttttggtggtccccaggatgttgtgccccaaaagccagggattcccaaaaggtctgccgggcccagaaagctgactcaccccatcagcggctatccaaaggttctgctgacaaagaggtagccctagtgctgccctaataggaggacttgagggccgggtcttggctctgatgcatctgcctttgagactgagccctgataactccaaaagccaagttgcctcaatgtaatctgtcaacaaaaagaatgttatgctctgttgatgcttttggtgactatgacacaggggccctgtcttccgcagaccctgcagggccaggctggcatagacccagctgagcaaccgtcgcctgagagctttgcttattcatccctctttactcctctgccccctgcaatgtaccagccctgtgcccacctccacggaaccttggttcaatcagggaggccccagtgacctcctcgatgtccaatccagtgctctttcctcaggactccatgtgccagtctctagtgcagttccagaaactccctccttttgcttctgggaggctgcactgtctggtttatttcctcttctctttttagttagggccctgtttttcctcctgacttttttagttagggccctggttttttcagttagggcccctcctctctttttagttagggccctgtttttcctcctgtcttttttagttagggccctggttttctttttctttctttctttctttttctttttttttttttttagacggagtcttgctgtggtgcccaggctggagtgcagtggcacgatctcagctcactgcaacctcctcctcccaggtacaagtgattctcctgcctcagcctcttgagtagctgggactacaggcatgtgccaccatacccggctaatgtttgtgtttttagtagagacagggttttaccatgttggccaggctggtctcaaagtcctgacctcaagtgatctgcctgccttggcctcccaaagtgctgggattacaggtgtgagccatgacgcctggcccagggccctgcttttcctgcctcagtgttccctaggattctgcccaccttcttgtcttgatttatgtatataggttcattcattcattcattcattcattcattcattcatatattcattcatttgagagatatttaggctctgagctgggtgttgaagaatcagcaaaaaacaagactttcccattcctcataggtcttcagtagatcattatttacactgaagattaattcttgctgtgaaggaaacgatcaggttatgggagcgtttgggattgggtgggagtggtgaggtcttatctggacagatcagggaagcctcccctaaaaagtgagacctgaagagggagagggaggtggctgagtgagcagggaatggaggagccccctaggcagagaggcgacctgggtaaggctttagtgagggggagtccttgaggaactgaaagaagtgagggaggctggccagggaggggggcgtggcaagaggagggcctgggggccaggcagcacctaggttatgtgggcccttgagtttggattttatgctagacctctgggaaccattggaagttttaaagcaggagggtgacttgcccagatttcattatcagaacccttgaaagggacagacacaaggaccatcctgataagccatgagggtgcaatttttggttcttccacatcagggtatcctgatgctgtgccttggtacggggcttgtcattgggcagtcctgggaaatgtgcactttcccaggattctctcagctctttgcattttttagtttacccggccagtccttgctaagctgctgcagtggagagggaggtgaagcagacaccaccgggccctctgagatccactctaatccaagacggagacagtggaagttaacgcccagagtgctctgtgataagtgccaaggggctcagggagacaaagagtgcttttccttacttgagagtcaaagaaggctgagaagggggagttgggcattccaggcaagaaggcaccgtaggcacaggcttggccgctggaagagcccactgcgcctgggggctagtgagcaggagtgtgagggttgaggtggggagctggttagagaggttttgaatgctgggtttctatcctctgggtaccagggagccatggacaggtcctcagctgaggagtgacttgatccatgggatttcagaacaattagtccatggcaggcagagcggagggtggatcagaggacagcagcactgggagctggttggagagaatgagtaccattgctgaagccttgtcactccccccaccgcacacacacagcaacatcctcaacgcccctttctgttccatacctctgttcggttatccccgaattggccggccagcctgagctgtccagagccctttcacagcagcactggggtgtgttaaaccctgggctccagaggcaaacaggtctgggcctgaaacatcaccgtagccctgacttgctctgtgcccttggacaagtcccttactcttctcagcctcagtttccacatctgtgaaatgggggtgataatggagttggtgatgattaaacaatggggaaatcaagtccttagcacatgtctggtgtataacgatggctgtgttagctttgtgtccttgttgattgtaatggcccagtccatgttgtaatctgcccctcagggagttcttgtctttggacataaatctgaattctcaactagaaacaagatgtccccagcagccccaaaggaagcctctagtgggacactgaggggattggacatgctgttacccactgggacccggcacagggctgggcacacagaagcctggactgggttttatttgttcctttatccccagcactcagcacaaggctggtacagcatggccaggtggctgggttctcaaaaatactaaacaaaaaaatgaaattaaaaaaaaattattaatcttggacatcatcccccagcacctttattttacagctgaggaatctggggcccagagaggaacagtggctcatccaaggccactcagctcctcagtggcaggccctgaacctgttcatttctccctgctcacatgtttattacaattctaatttttgaaatcctggtaagttaaaaatggcatcatgtcccacctccctaatttacctttggggaaactggggcccagagaatggtagtgactccttcaggtcctcagagagggagaagcaggaaaagggcctcctctccacaaagcatacccccactaatcagcagtaggcaggcaggttcttccccccaaaattgacggccttgtgcttaaggaagcaaagtggagtgtgaacaatagtttcctgaggaagtgttgggttttaattgtgttgaggagaagaaccatttccggaactgtgtgtgcctgtgatgcctgcggagttggcttggcacagctatttccagactaatcctgagtcctatttataggctgagatgattaggttggcctgtgtcaggagaggcccacatagctccccccagcctcgcgatggccgaggaagaagccctcaggggcaattctgacccatgggtgagtagcacgggatctggggtggtccccgaagccagctcagaggagggacgccagggagacccgagggaaagtcccgctcctgactcctagttcaacaccagccaggccccctgcagagatgaaaccagttccaattctattctctccctgcttaaaaatcctcagtgtgtccggtcaggccaggactccgtagcagtcagaccccttctccccgaggtatccactgtctcaaccccagccatgcttctccaaactgtttacgcttccttgtgcaggccacacccccaagcctttgcgtctgttgttcccaccttcccaaaagggaaactccatttatcctccaaggctctgccccaatgcccctcctccgtggctctgttgggccatgggtgctccctcctttgtgctcccagggcccacaactgcttgaatgactattggtgttcctgtttgtgtgccctctgggccgggaagtcagagaaagaaaggagacaatttgtgattgaacagccactgtggccatcattctccttacctgtctgatgagagctgatcttcatgccactgtgtacagtaggtattttttaaaggtgtgtagaagtgagagtcagacttcggacttcagagtcagacagccctgaattcctaatggtgtaaccttgggctgaacctctctgagcttttgttcctccgtctataaaaggagacaatgccagccatgggttttggggaggattcaacaagacaatgcttataaagtacttatcatcacaatgggcttctatgagcataggaggtgttatttgcagatggggacgttcattccggggacgtccctatctagggccccacacaagggagtggctgagactccaagtcttggagcctccgactccaccctgtgttctccctcccctccctctcttggccccctgggcctattctcttccccagatcagggaaagctttgtttggcgattgtttttcctaagaagtttcctctgtggggcctctgggtgactcagccctgagtcaccgggaggctgaggacagggggaggagtgggagggaggcggagggaatggagagacgagaagaggaaagggctctaattctagccctggctctcccactgtttgatcaactaggtctgaccaggcccctctcctgcctagcctcagtttccccaaatgtgaaaggaagatgtgggcccagtcctggctgagcctcagaatcagaggttcccgggccccaccctagacctacagactcagaggctaggggtggggcctgggaatctattgtttcctgagctccttgggtgatcctgctgcacacctggtccacagaggtgttagggaactgctcggctcaaactggctcccagctgggcctcagagcagctcggcctctgattgaacttcactgacccacagggagcgcccttctcttgcagaatgctttggcagaatagtacacaggaagcgtgtgggctttttttttcttttttttttaaaaacagctttattgaaatataatttacatgatttattggagtaaatttacatataatttacatacacataattcactcaattcaataatgtttagtacatttacagagttatgcaaccatcatcacaatccagttgagaagattttcatcatccccaaaaggatccctcatgcttgcttacgtccatctctatgcacaccccatagctgaccacgcatctgctttctgtctctttgttgttttattgttgtattttttgtcacccaggctggagtgcagtggcgtgatctctgctcactgcagcctcaacttcctgggctcaagcgatcctcccacctcagcctcccgagtaggtgggaccacaggcacacaccatcatgcctggctaatttttgtattttttgtagagatggggacttgtggtgatgcccaggctgatcttgaactcctgaactcaatggattcctcccgcctcagccttccaaagtgctgggattataggcatgagccacctcacctggcctgctttctgtctctccgaagatccagagctgtgttcattccagctggccctgtgacctcatgcaaattattgcccttccattactcctctgtatgagagggaataatcctaccctccttgtagggggttgtttgaatttcactaatgtgcacagtgtctgacgcacccgaggagctgggcacgtgggaggctggtacgcagggcacaggacataacacagatgcccaggtacggttggcacaggcctagcaaacattttaaagcactcactctgtgccagcttcttagattaagcatcttacatgcattacctactttaatcctcggtgaatgtgagtatcagtttcattttataactgaagaaacgggcactgagacgggaagtcacttttacaggctcacatagatgatagttgatagggctgggagtccatctgagagcctgtcctccctaaacatcatcctgtccccttcctgatgtgaatcaccaagcaagggacaacacaattcatagatccaggacaaggtttatggcacatacttctaaggggtgggacctggtatcatggacacggcattcaagagatagtacatggtatagagtctgtcacaaaacagacatcacatggtgcatgaagcatgacccaggggtaagaggcatgggatgccgctaaagggagacacacaggacaaagcaagaggaacgcagggcctgctacgtggcacagtcacagggtatgtgacactgggcatgacaaactctatgatgcagagacatggtacttaggatttgagacttgagctatggcaactgggcaggctcttggccacagtgggaccctttgtcatcagggatcctccattatgttggtgcctggggccccagcaagcaacagcaggaaccaagttcctcctcctcacaaaggcagtctgttttttttttcttttttttctttttttctccctcctcctccctgtctctttggatgccaaagagtgggaggggcccagcggagtggtggccagagtaaccccccgccatcccatcagctcagacaagggtcaaagcttggggccaagcccacggctcaggaagggtttgccaggcccccagatcccctctctctgagatagctgtgagcaccagtgttggctggggtgaaagccgggtaattttcctctaagctgtcctccctccgctcccctccctgcctgctggtgctggctgtgagcacgtctgcattccagagcttaggagagagagaacctgctgctgttaaggttgaggaagtagattgctaacagctgctgtaggaggggttggatgtgcggaagaggaggccgtggattgcaggctaacatttcttgagcctcttggcacctggcactcactacctcatcttgtctcatttgcataaagccccagtagcccggtgaggagacaggcccagagaggcaaagaacttgcctaaggtcacacagggaggcagagccaaggctagaccttggtctcccggaggcaggcaggtgaggttgtatagaggtgatggcacaggggatgttgttggggggttagtgggcaatgagactgcaagggcttgtgggccccatatcacagaggaccgaactcaggagtcctgacttctttctgtctgcaccgaggtctgcagaagggatgatgcaatctgtatgagtgacaggcccagtgcagagagagtttaagggagtgagggagctgatgttatgatcccagggaaaagatggggacaccaaaccaggacagtggctggagtgtgggggtgagaagtgggtataaagtggagaggagatgagcttggtctctgctctggtctcagcctttatgtactgtcttggtgggatgaccgtggttgggtcctgcctccaagggtatcccagagggttctagaaactcccacatggacaggcacttgaaggatagtgctggtgattgggcaggtgcctggatggaggtgaggcctaaagcacacccggggacagaaggcagcacccacacgggagcccagcttcgtgccagggactgtattttaggtgctggatcttgtttaaatcttccggctggctatgattatcctctaagctggggaaggaagaaaagcattccagtactatacctctgtttgggttaaaggaggggaaagtattttaaataaaacctattagagttaaaaggatgagtagcaataaaaatatctttgaatctctgatggttctattgtagtcaaaagttttagataaattgtgaagaatctctaatcatgctatgtggagtttttctcttttaaaaaatacaagttattgtatatacttaaggtatataacgcgatgttatgaatacatttagatagtaaaaaggttactatagtgcagcaaatgaacatattcatcatctcagctggcacaaaagtaattgcaatttttgccattactttcaatgacgaaaactgcaatacttttgcactgcactaataaaatctgctcatttagcatgaatcccaaaatacagtacaacttattccctatagtcctcatgttgcacattagtgctcttttttatttttaaatttttatttttgttatttttaatatagagagagacagggtctcacgacattgtccaggttggtcttgaactctggggctcaagtgatcctccctcctcagcctcccaaagtgctgggattacaggcacaagctctctacacttgttcattccacgtatctgctaccttgcaccctccatatcctcattcgtggattcaaccaaccacagatcagaaatattaaaaaaaaataaaaattaaaaaaagtaaaaataatacaaattttaaaaacagtgcagtgtaacaactatttacatagtttattgttacatagaaatttacatttacatttttatgtaacaactacagtataacaactatgtaaatagcatttacattgtattaggttttataagtaatctagagagatttaaagtttaatacatgggagaatatatgtaggttgtatgcaaatactgtactatgccattttatatattggtgtacagcatctgcagattttggtatctgagggaggtcctggaaccaactgatcccgcgtggatagggagggacaactattctctgatatgtctccccactggacttttttttttttttttttttgagttggagtcttgctctgtcacccaggctggagtgcagtggcgcgatctcggctcaccgcaacctccatctcgtgggttcaagccattctcctgtctcagcctcctgagtagctgggaccacagatgcccaccaccatgcccggctaattttttgtatttttagtagagatggggtttcaccatgttagccaggctggtctcgaactcctggcctcaagtgatccacctgcctccgtctcccaaagtgctggaattacaggtgtgagccactgcacctggcccccattggactttttctctaactgatttgtacttgtatcaagttctggtgagtccgtgagataatatggccattctatccctgtggacactgaagctcagagaggttgtgtcccttgctcagcatcactcagttgtaagtgctaggactgggatccagagccctcacttttttgtttttggttttttgcttttttgagtcagggtttcactctgtcacccaggctggagtgcagtggcacaatcataacttactgtagcctcgacttcccaggctcaagtgatcctcccacctcagcctccccagtagctagaactactggtgcatgtcatcacgcctggctaattttttaattttgtgtagagacagggtctcactctgtttcccaggctgttctcaaactactgggtttaagctatcctcctgccttgggctcccaaagtgctgggattacaggcatgaaccaccatgcccagccaagagcccttgttcttttgggtgaggcagaacaggcaaagtcagagaggaggggagggggtgtcattaggagtctcatggaggggattgggtagcaaggctggctctgtaggtgttggcttgaggccctctcctgagatgcatccccatccctggtaccagccttgtttggaaccctccctgtctcccttgctttgtatgcaaagacacagaggtagagggctaggtatgaggtaggtatagggcaggtataggggccagtgagctgtatgtgtgtatagggtctggacacatgctgtaggtcatctttggatgttatgcttactgagcacctgctgtgtgccaaacacagtgccagggctccttcagtcctaccagacaccccaccaggttggcatcttcacctcattttacagaggaggaaattgaagtgccgcagaaggtgccactggctcaagttccctggtggtagggatttgggctctgtccagattcatccctgtacattgcctcatattccttaggttggaaggtcacttgtcctcaccctgttggtcatttttggtatctccagcccacagagactccgcaggcactcctggatcccattgtcttttccctcttccccgcacctgcccccttttgtctttctcagggagttctccctgcagagtgcctttgcggggcatggtccacggatccctcacatttatggtctcatttaatcgtctcaactagccttcaagaaaggcactttgaccccgattttccacatccagacaatgggctcacacttcctgccagagcccagcaaggaggaaatcttggccatagttggtatgggaggcttggggacacagaagggctttgtttgaagccagcagcaggagggatgtggcaccatcatctgatgtgctgcatcattcattgtccccatcgggaaggtggttggcctggggaagcttccagcattcctggtagatcccagtgaaggatgaatctgatccctaggcaggcaggaggggaccctggccagatgcacaaacttgtttgctttttgctgtgtgtcttttagcatccttgagtcccagggcctgaagggttcttggacatgggccgattttcctgtcacctatgtcccctcaacctcatcaccactgggcagctcattatctctctggaaaaggggaaggaaaccagcatttgtctttccatttttttttttttaaactgtggaaacatacacacatcataaaatttgccatttaataggccgggcgcggtggttcacacctgtaatcctagcactctgggaggccgaggagggcagatcacttgaggttaggagttcgagaccagcctggccaacgtggtaaaaccccgtctctactaaaaatacaaaaattagccagaaatcacttgaacctgggaggcggaggtggcagtgagccgagatcacgccgctgcactccagcctgggtgacagagcgagaccccatctcaaaaaaaaaaaaaaaaaagaaaggcatttttaaccctatcttacatgtaaggaaattgaggctcagagagatagaaacttatccaagtctctcttttaacaataaaagcagcctcctttatatgtgcttattctgtaccaagcactgtgctaagccccaaatgttctttaccttattaaattcacacaactaccctaggaaaaaagtattataatccccgttttatagatgaggaaacggaggctcagagagccaaaacaacttgctcaaagccacactgctaataagtgatagaccggggacttaaatgcaggcatttctggtgggagctctttccacgatcacataacagaaggttgctctctgtttttctccctcttggaaagtccttcctctgcagagcaggaagctgcctcctgtggcttctcctgctcattctggcttgggttggggcattgtagaccctgccttcccctgcagctctgcagagcctgtgactctccaaagtcttctgctggttccacggtcccagcatctgcagccaggcctccctgtcttgttgtggatttgcgtttgtgcctgggcttcccaggggtgggtggtggggtgctgaaggggctaggacagttatttgcagccctggctactgacccaccacacctctcagggccatttcctccccgagagaaggggagacagactgctgaagtgggtcctagcaagaagggcccagagctcatacccatggccaaatctggctgcttccaggacatggggtcaggaagtagcagggccaggcccctccagatgtccagccctgggtcccagcactaggtggggctggctccggaagctgggaaaggaccatggctttggtccctgagacagttggtctcctggagttggcttcagccaagccccgctggccatctccccaacagctggccactcccaggatggacttggccaaagcagaaggccagccagccccgatggggagcactgctgtgtcatggagacccaggcctcagttctggcctggttgttgagagacctgagttctagatctactctgccaggcacttgtttgactttgtgaccctgaaaagtcaccctcttgttcttggtgtgatcatctacaaaagagaagacagactaatgaacactgctgctaataagtcctgctctgaacaacatactccaacagtctcacttctgttcccccaaaagtcctgcaactgggcatcactgtccctgtttacagatgagtgacctgaggctcagagagggaaggtaacttgctctgccttacacagcccagacctgaactctagcgtctcaccgtgaaatctgtaacgtttctcccgcaccatcacataccgaaggcaggcgtctgtgcagaaaacaggctgctcagaaagaagagtgcttacttttggcgagctcctgtgcgtcacatcctgggcttcctcactgctccatgctctaggtaccattctcccccttttagagatgaggaaactgaggtctggattgcagaagctgagtccagattcgcaaacctgtccacagggcttgccggaacttttccaggccctgttcagttccactgggtttcataactggcttctctgtttactgaccattgtcccaattagcaaaatccctggtcagaagggcgggtgctcctaggaggacccagagaacagcagtgagccaaaaagtaaatagactccaagagagggctttccatgagtggctggctgcctggaaaatcaagaacaacagtgtttggagtgaagagaaaagaacagggtggtgtcttccaggcccagccaaggcctttttgtacactgtggctggggatggaaggggcgggggaggccacctcctctggtctctggtagggggtcccgcagacatacagagaccaaggttacagaggaaaggagggcccagagctggttgtgttgtggaggtcctgggtcaactacaggggagggaggggtcccccagggggacatgggctgtacagcccccatcctgtggcagacacagagaatctgcctactgtgtgcctggagctgggcaggatccaggaatagccgagatcagaggtcaaggagatctccgaggtgcacagaagcagagaccaggacatgctcatgtactgagttggtagcagaagggctgcctccaaatcaaagaaaccatgccagacctgagtgccatgtggctcagagggcaggtgccacagccagtcctgcactaaatggccacagcctggggatcttccaggcctttggcctgggcagtcacatcaggtgtgtgaaaggctagagggctttcccggtgtcacctcctgccctggcctgggaagtgtcgtggggacagctgctccggagactcctggctgccaggcttgacttgggcttgattgatttagcctgttacctggaaagggcactgctgctccctgcccaggtcaggtggtgctaggagctcctgcttggtctccgcagacagagcctgggctctgaagccagtcagacttgtgtttgaatcttggcaacacctctttccagttgagtgacttgaacctccctgagtctcagtttcccaggctgggcccagaggtgaggtggcatgctgctatcagtgactgcagtgcctccttcctcaagtcaggggctgtggactgtctgatccagaacggcctgcagaggtgacctggccgaatgtacccattttacagatggaaccctgaagctcagagacttgtaggtcctggatttggttgtacaaccagtatctggtactgcttgggctaggaaagaggcttcgagtcagagcatcaggccctaccctgtattttgcatatgaagacactgaaacccagaaaggtacagtgacttgcccaaggtcaccaggaagtcagtgtcagagccagccctagcactcgggcctcttcctttccacctaggggtccttctcttgtacctgaattcccccattcccttgaactcatacatcttcttccaggctggaagcagagtaagacaatgttgcccgcatcatggtctccactcatcagtgccctgtagcaagggctccagggtctgtagtgagggctcccagagggcaagggtggggtctgttcaccagctctcctgtgccaagggcctgggctccagagctatatggcaggcaaagctgcaggccctttgtgatcattaacgtggtccctgggttgatggccagtggcctctggggccaaggtcaagccacagcagcccctctattaatcaccaactatgcaggtcagagtcacactgctctggaaggggcccctcagctgggcagttgctggcccaggttcagtctgggggctgggcagctaagaaaatttcttcctacttgtttgaattttccaaattgtctaatgagcaggcatcactataagcatattttaaaagggattgtttctggatttgtgttttataaaagaacaaaactatattggatatacacttgtaaagtttcaaatgctacggcaatgcttttacaattttttcggctagtatattaaggtataatttacatatcatagtgattcacacactaagtatacctatagttctatgaattttagtagatttaattggttatataatcttcaccataatctagtattagaatatttttatcaccccgaaaagttccctcatgccaactgcagtgatctaggcacttcctccagcctcaggcagccacggcaatgtttgaggatgaaattctcctccttcttccctttccagcaaacggccttaacagtttggtgcttaccctctgattttttaagggtatatgcaaaaacaggcaccattgtaaaaaggagaagaggagatatactatagccattgttgtgcaattgctttctgcacttggagatctccctgtgtttattgagtgcctactatatgccaggcacaatcagacgtagctcattcttttttcacagctgcatagtgtctattgtaatggtggctccatcatttatttaaccaggacttttgggtcctttccagttttcttcaaacaatgcttcagtgaacatccttgcacatatatttttgtgtttgttggtaagtaattctgtagaaagtggaactgttgttgcgttgtgtgttttgagtttggataaattttttatctagagaggtgaaactggtttatgcttccattaagagcctatgggagctgtggggttttttataatatcatcctccaaatggctagggggaagggagagctctctgaatttaggccagagctggcccactgcaggctgggcaggcccaggcctggacttggagcccggagaactcaggtatccctctggggccccccacagacaccgagacaaagttcagactcttcagtgtggcacacaggcctcggtgacccctgctgccctctgcagcctcctctgctcttgctccctgtgtttcatactggacccctggtaattcactggatatggttatgtttgcctgccctttgcctatgcgtcccctccccctggaatgtcttttcttcttaatctccgtcctccctgtccttcaaggcctgggtcacaagtccctttctccacgaagccttcttataatctctccagcctgaattgtcttctctgtgttcctttagtcttttatctgaaccatatccccccttaggtgggagcaagttgtgggtgggagagggcaaacttcagcctcattagatagaggctggacttccggaagagctgggaagggggaccatagtttctggggaggggtggagaactcacatttacctagctgctggccaggctattttcatacccacagaccgatttaattctcaactactgtactcatttagtagatgagaagaatgagacattgaaaacatgcacagtggaggtgggaatgaaagccagctctccaactctccagtcctctttcctgtcactgcatcaggctgcagggtgaaggggaggtctgggatacaaagagaacttagaggtggagcagttggattctgtgcagtgctaggagggaggagaggggttggagtaggtgggaagtaggcctccttcagtttggatagcacttcccttaacccaatgactctagtgggagggtggagggatggggatgggaagggagcctgggagtgaggaggaaaggcaaactctgtcttcccccaggggagtcaatgaatagtacctaaaatggaaaccaaacaaaacaacttcaggaagtaacaagggcttgcttagagacatgacggtaaaccctgaaccatcagctaaaagaggtagatagcagtggttgcccctggggagaggtaaatgtgatggagagggaacaactgtgtacaaacatgtgactttacgttttgatcaaaataagacttttaaaaaacaaacactttttaaaaagaaggaaagaaaagtaggaggggctatcccaggagctgagcgttctgccccgcccctctgagtcctgccggcttcacctgcccacgggagccgggtcccctgccctgctgcggcgcatgctgcctggtgggggttctgcccaggcccactacggcctgagttcaaatcccggcagcaccatttacaagctgtgtgcaagttgcttcaccactctgcgctgttcccccctctgtaaaatgggttggccgttgtaccctctctgaaaaggatgtgctgatgcctcggtgaaaagctttcaaaaattgttagttcatgttatttttttgctggaggtgttaggtgcggagaggcgagggggctcgcgtgcgtcgcaggaggctcagctgggctcgccgccgctcgtgcctgcgcccatttagtgtgcacacagctagcgcccgccgtatgtcaggcctggtgctgggtctccgccccggagctggggtgcaggggctgccgcgccctgtcgggtcgatccgggtgggaacccagatgtctccaagatccgagacagatccccgccccgcgccctccctggggggcggtccccggcttgggcgggatgggcgggcggctacttaaggtcggcgacccgaggccgcggctgccgactgggtcccctgccgctgtcgccaccatggctccgcaccgccccgcgcccgcgctgctttgcgcgctgtccctggcgctgtgcgcgctgtcgctgcccgtccgcgcggccactgcgtcgcggggggcgtcccaggcgggggcgccccaggggcgggtgcccgaggcgcgggtgagtgcccggggggccccggggctcccggagtaactctctattgtaagttcttgcagatacagcgctaggaaaaggggagtaattcaggtctagaatggaaaaactgttttgttgctttgtaagtatctcttgctgcttccggggctctggctcgcagacgagggtgggagcctcggggccctggctgttccttcccaggaagctaacctcaccttggccggatttcttttcccctgtcctcctctaacatcttacctcctgtctcctgaattctccttttccttctctgattttttctcccctctgcctcacttctctccttctctcttctgatgtcttcttccatttacgattccttgttctcatttgatctctctccttctccaatatttccttctttcttgtatgacctcgcctgtctgcttatggtcattattatcatttcttctctcctttctgctgtcttccctgccctgtctggtttcgtgtttttccacccttctgcctgagttctccccaccttgtttctctgacttctctcctctgatttttactcccaccagatctcttctccggccagaggtgacctgcacctgctgatttttgtcctcgactccagcctaaccctcctgcaccctccccggccccagccccagtgcatgtgtaatagcctccccatttttaaccacttcatctccaacagcctcctgcagaccctggtgcatcctcttctcctcttccaagaaatgaaatttgggggtggtgtgttgtggggcaggagggaggaggcagacagcgcaggaggccacttggactcagccatttggacccttcttgggggtatgatggggatgggtacagagaggagagggggctcctgtggatcacaggaggctcaggtgggctcacctcgatttgcgagtgcacccacttagcgtgcacagagctagcgcctgctgtctgccaggccccgtgctggaaatctttccacttccaaagagcaaaagcaaacaggctgtgtgaccttcggtcagtcccctcccctctttgagcctcagtttctctgtctgcagattggggttggataatgagctctcagagggccctttggtttcaagagccattgaagatgctggaaggaagcaagctgaggccctggggacccttagatttactattgccatctgaggggtctacccatcatcccagagcttgtgatcttggagcctggggcaacccctgctacactgtttcctagctggaggtccctggcagagtcccttcatctctctgtgcctcggttatcacatccaattggcaataagaaaagaagggaggctgggcgcggtggctcacgcctgtaatcccaacactttgggaggccaaggcaggtggatcacctgaggtcaggagttccagaccagcctgaccaacatggcgaaaccctgtctgtactaaaaatacaaaattagccaggcatagtatcgcatgcctgtaatcccagctactcaggaggctgaggcaggagaatcgcttgaacccaggaggcagaggttacagtgagtcgagattgcaccattgcactccagactggacaacagtgcgagactctgtctcaaaaaaaaaaaaaaaaaaagaaaaaaagaaagaaagaaaagaaaggagcagggaggtagagccctctgtaccctccatcaccagaaaaagctgaagaggggctgagtaggagggacagatgctggccagggcacaggttttgaagcataaaactcttgccctgtttgctgactcgttgagacagggtgcccagaaggggatagacttccctggggcgtggggagagcaggaggctcaagtgagatgctcttggtgctagaaaccgccctccctcatgcctggggtctctccctgccaggaccctgccccgcttaggctctgccctgtctcatcccagcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggtgaggctggccctgcccagcccctgccccagcccccattctgaacagtgcagacctttggggcatggtccccagggagggaactgattattgagcacctagtatgtgctgggcccttgactggtggttcatgccctgagacgctagagccagcctggccaagttcacacccccactctgcccctaacccatgttctgtcctttggcaagtcacttagtgtccctgtggagtggacatgatgatagctctgcactacctcacaggaatgttgtgagcgttaaacaccttactgtgacactcagaactgtgggtgaattggagaccctggacctctccacaacttccctggcccagctccaggcactccccagtttgcccttgagtcaggagcccggagtccctgccacacctctgccgtgggatgctataagttctgcccccttgctgagcctcagtttcctaatctgtgaattgatctgatgctcccagtcctgagtttacgctcaggagggctgagaatgaacataagggaatgtgacagagctgggaggacgcttagagaaaaatgaggtccatcgtcctgttatacagatggattaactgaggctcacagaaggcaagggctttctcagcttctacagctaggtcagggcagtgctggggttcctcctccacctcctcttcctcaggggtctgggatacttctggaaagccaggctcatattgctctgatgtcccgtaggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaaggtgggttgggccccaccttgcttgagcggtagggacagatgcaccagtaacagggctcactcaggcccatctatcttttggccttgtgatgcagtgggcagaccgatcagaggtcaggctttggagtcaaccaacattgtgtttaaatcctggcctctttctagccatgtgagcttggacaaatcacactgcctttctgagcctctggttccttatcttaaaatggggagaagaaaattccccataagttcatagtgttgtcttcctagccccaacagtgaggagtgggccagaggtgaaaatccagttcttcttgcaggccctggggggctttggcctagtcctgttctggtaccccttaattcttaaggccttgccaacagagggccccgtgttaagtatttaatagggcattgttagtcacatccctctttctgttcactagaatcccctttgaacttgaactcttcagagtctggatcaagacagagctcttttcccaagctcctagccaggtggggcagagcaaggccaaactgggagctccaagaggctgcaccctaatatgctggtgacttcctgcaagccacttgacctccttgagcctccctttcctctctggttacctgagagccagttgtacctgccctacagggctgggagaggatttggtgtgggggtggctgggaaatgccttgcgtggggcttggccatctggaagggctatggaaacactgtagttttacaaagctggggttttccttggtcaggatagagaaggggatcacaggctttcacagccaggtgggccttaatgtcagagtccaaatctcattttaccaggggagaaggggaactgagacacagaaagtcttaagcaattggcccagagtcacacagcgaattggtgccagacccaggactagaacccagatgttctgactcttagcattctttccactaaaccaacatacctctaatgaccagggtcctagggtagggtccaagcctgtctgtgctgctgatgtgctgtgtgaccttagagaagtcactgttcctctctggacctcaggatcatctatgtcaatggagtggtgaccttgtctgccctggtgaggcataagagattgaatgatgggaaagtgccagtgagactcagatagcaatgggcagggtgtgtcctgggaactcacagtccagggctgggcagggctgggctggattccctggagccccttgtgcccttgcactgagctcctcctgctgaggtgtccagctctgccttcttcccacagccctttctggggccttgataccttgcagaaggagaggtgagaagtttgggagccagtcccctgagctggagaaggaccaggtctttttgcaacttctggagcaagaaatggaacgaacacttgcccaggaatcacagagattgggattcaggttggaaggctaccttctgtaactgctgtgagactttgggcaagtcttgtatctttgggcgggtgttctcaatcatcctccattcatcattcattcagcaaatatttactgagcctcaataacagcagcaccagctcattgttgctacactatggcagatatggtactgggaatgtaggttatctcgtttcagcctcacaactgtcctgggaggtaagtaattcccattccattttacagatgagactggaggctcagagaggtcacataactatattcaaaccaggattgtgttcccttaactctgccaggccctgtgatgggtgctggggtgcccaagtgaagaaggtgggtccctgcccttgagagtgttctgaggagttggggagactggcaggctcacgaagagttaatccattgcctccaggtggggtgatgtgggatcccagggagtgctcagctctgagaggggttcagggatgagatagatgagtaggtgtttgctaatctatcttgtcctagtcactgtttcttagggcataacctgacagtctaacatggttacaaatatgagagttctcatatacacagaaagggtgattttccaggtcagagaatgttgcagagcaggtcataggctcccggatttttaggaataaacaaggatgataataacccttaccgtgtgttaagccttgactacaagatctcatttaattctcactgtagcctttagggtggatggtaatgctccatttcatagacgaggaagctgaggctcagaggagcaaactaacttgcctaagttcacacagctagtaaaaggtgcttgtcattgaacacttatctattactttctgtgtgtcagggactcttctgggtgctttactcatttaactcattttaccctaacaggtagggtatctgttagcaccattttataaatgaggctactaaggcacagagatgttaagcaacttttccaaggtcacacagctagtaagtgattggactagtgtgcaaacccaggtgtgaagggcctagcacagacctggttcagagtagacatttggaggctccctgatctttgatcctcgctcggatatggcctgggatctacttggatagccaggttccccggccccccgatgattttccaggatgttcttggatcacactcgaggaaagctccagctgggcccagatttggggcttctgtcctgaaaggcgctggctcctggtgtgaatgggaggcccagggctggtcttgtttaccaccttctgtaagtcctcagtctgcccccgcacttggcaggtccagcccaaggttctcgccccggcgccctcatcaattatagatcccggaggagcagggcttgttatgcaagacttgttcctgtgaaagcctcttcctctgagccaattctgtcctcggagtgtgagaaggggcagggaggggacagcaagccactagaaagggctgacatggggcttggccctcttgttctatgacccccaaatccttagatcactgccctgcaagagagttcagaatcccttgattccccgcccctcctcctcccactccgcagacccccatttttggactgaatcctggagaccccgtggggctgggttatttgaaacccattgttcaaatggaatctgggctaggcagagacctaggagcccttggacctgaggaacacaattgggaacccatagaatcactggaacctttctgtcctccctctctcctattccttagataaggagctctgagtttagagggtggaggggcccaagcctgatcaattcatttttctttgttttagaaacagtttaacttttgttttcatgtaaatcttcattgcttcttttcccccttcttctgactacaagagcaatataagcttattgtaaaatgtcaaacattacagaaatataggttccagaaaataaaagccctcccaacatgattctccccttggagatatatagtggctaatttctttctgtctctctgaacgtatataggtagacagacacatatatatgtaatcactttaatttggaaaatggcttttaaaacaatttatcctgtagaattttgttcaaataatttgatgccaatcttgctcacctaatgattagaccacagaaagcagcaatcagtgctaaagatgatagtcaaaaacaggaaaaacttcaaaaaacttctttcccctgcccttgtagatccactaatgtcttctaagagcttgctttaatttatttttgttaattaatctttccaattctaattccctagaccagtaaaattagaggagttaattaatcaggcagctcatggctgcaataattcaacatcaagagttatgttataaggccgggtgcggtggctcacacttgtaatcccaacactttgggaggccgagatgggtggatcatttgaggtcaggagttcaagacctgcctggccaacatggtgaaaccctgtctctactaaaaatacaaaaattagccgggcgtggtggcgggtgcccgtaatctcagcgactcaggaggctgaggcaggagaatcacttgaatctgggaggcagaggttgcagtgagccgagatcgtaccactgcattccagcctgggcgatggaacgagactctgtctcaaaaaaaaaagaattattttataaataaatacagagaatttttaagaagtgagatttatgacatgaagcaacccttttcctttttaaaaaatagggtaaagattttaataacaaaaatgaaaggcatacttcaacaagtaaaatatttagaggggtaaaaattttttctttccccccatttccttgtctccgaggaatcaatagaaacagtgagtccttctagcaccttttggaaaaggtttgcacatccactctctcattatgtccaggtgaatgaagtcccctggtcaggagttcctaggctgacagttgaatgaagctgggtccctggaagggggatcttggggatagaacccagcactgccgcccagcactgggctctggacacaatgcttaatctctttgaatctcagtttccttgcctttgaagtgggaaaattattaatagttcctgcatcaggggcttgtggtcaggacttcattgcatgcacttaaagcaggtgccccagctttggcaaagctcggtaagtggcagccactgtgcttgtttcaggtaagcacagctgagcacaggtgagcgcaggttgttgcattttcttccctggcggttcttcctcacttgctctgggcaggcttggttacatcggtctcagaaccctcctgtctttctgcgcttcccctgcctttctgcgcttcccctgcattgccctgacctatgtcctttgcactctgcctggctctccaatcccaggcctcacggccatccagccttcggaccccctcagttgtgactgcagttgtgactgcagctggtcagtccctcaccccagagtcccaactcactccttcctgatgatggaaaaatttactgtcttgcttcccagttttgggcagcaaattcaggagcagaagtcacagtcttaccccttgctccacaccgaggtcagtcatagtgtggccaacccacagctcccttgaaggggccctggaagcagggtggaaagataggttgttagctctgtgagcactggccgccctgctagtcccaagggactcttgaaaggccttagctgagaccaagaagggacaccagggagtcctccagccactggcaacccaaaaacatccattacttgaaagagggctctgaataatggcttgttcctgcctcccatcctggatgactgagtgatctttgctctaagaaaacctgatattggctggcacagtggctcatgcctgtaattccagcactttgggaggccaaggcgggaggatcacatgaggccaggagttcgagaccagcctggccaacatggtgaaacttcatctctacaaaaaatacaaaaattagctgggcatggtggtgcacatctgtaatcacagctacttgggaggctaaagcacaagaatcgctggaacccaggaggtggaggctgcagtgaattgagattacaccactgcactccagcctgggcaacagagcgagaaaacctgatattgagagaagaatgtggatcttacagattcagacatgcctgggtttgaattctagctccaccaccttgggcaagtcccgtcacctgtgggccccattttgcacatcagtgcgatgcagcaatgacacctcccttgcaggcgatgcgtgaagaatgcccggcacagtgggcatcatcatttcacaaacacgtatactgctgacacaggaagacagagcaggagcccaatatacacggactccgtttgtcccttgccctcctcgagtctgtgcggctagaattagacttagcacagtgggctgaggggccctggatggggtggctgcattgctggcctgagtggaagccctctgcttccacccccatgtgtctccggagcagggagacgagcacccgattgggaggaggaaacaaggtttccagccttggcttggccacgcacttgctgagtgcccttgagtaagtcacttcacttctctgggcttcagtttaccgtgggtaaagtggggtgaagtagaaggacctttccaactctgatttgacaactctggggcatggagctggggactgctcacaggaaagcccagctgactttccttggcttgcttctgagtgagggcagttgtgactgcagcagggaagctctcctgaacgccttgctctgggatgcagtaatgattacagagggctggggagcaggagcttgtgtctccacttcagaaaggagaggcctgaggctcggaaagggcaagtgacttacccaaagccatccagcattgttgtggcggggcacctgtcccttacccatagctgctctgaagggactgctgggtgggagttgctgcggtaccgtaggggaaagcagaagggtggcatgggctggaacaatccagaaagacttcccagagagccttgaaggatgagaaagatttggattagtacctctcaaagtggcttttgcaaaatactcaagctggaggcaggatatggtgaagaaaagtggttcttgggctgggttcagtgactcactcctgtaatcccagcacccaaggatctcttgaggccaggagttcaagaccagcttaaacagcatagtgagaccccatgtctacaataaaataaaataaaataagtaagctgggcactgtggctcataactgtagtcttagccactcgagaggctgagatgggaggatcattcaagtccaggagtttgaggttacagtgagctgtgattgtaccaatgcactgcagcctgggacagagtgaaaccctgttgaaaggaaggaagagagagagagagcggaaggaaggagagagagagagaaagagagaaaggaaggaaggaaaggaaagagagagggaaagagaatgaaagaaagaaaaaaagaaaggaaagaaaaaagaaagagggaaagaaagaaaagcagttcttggttcaataagatagggaaatactgtataaaacaaaaggcaagcaggtgtattcaccataggatttgacagagcctttattatgcacatgcgcgttgtataacagtcagggagggtgagtgagaagcattccctatgcttatttgaccgtggaactctttccttgcagaatgtcttaggggactagtgtgcctttgggaaacgccggttttgaggaaggaattgttgcagtttttttgatttagaaagtggctacaggggtccttgttagtggagtatgggattcaaaggggtggcagaaagatgcagtgggcagggaatctctcacttcttagctgtgtggccttgggcaaattttattcctttcctaaacctcagtttcctactctgaaacagtctcaaacaagataatgggtatgaaagtcctgagttaactgagaatcactgtgttgctggaaagcccctggtccacaagccagaatttcctttacctcaattctgtccccttcttccatatctgcttccctgggccttctcccctgggctaatgctgtctctttggccccacagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacgtgagtcctgctttcctctttcccaggagccactgaggtgctcctggtctgatcagggacttgggtacatccacgtgaacaaatgcatagatgcaggtgggcaaaccacagggaccagcattgttcacgtacagatatgtctgtatgcaaagactcccacaaatgtagactcacaccacgggtatagtgcgtacttggactttgattgacatatagacttcctggcaccttctgttcatatgtacgtcttgtgtcctttttcacatgcttataaatatataacagtcatgggcaaacactctgggcttttgcccaccaggtgtgcacatgtgcaccatcatgaatgcccacacatgtatactcgggtatgttgtttaaggtcccacatgtgtatgtcatacatgtagttgcacatgcccatgatctatggcaatgtgtgtgggatgcccttacccaggcccaccttatagatgtgtgacgctttgtacacacttgtctcacaaatccctggagcgcagacctgcaaatggacacggcccttctaccccaaagctcatatgcttatacacctgtgatataatgtccgtgcaaacatgagcacacactgatttagtgtaagctttttattaaagcgtcatgggcacacagaggagtgtgtgaatcctgagtgtacagcttgatggattacacagagcgaacacactcacgtaacactggatcatgaagcagaacctcaccagcccctagaaggccccttttgcccctttcggtgccctcaccccaagggcaaccatcatcctgaactttctcaacagcatagatgagttttgcctgtttctgaactttatagacacggaaccttgttcttttatctctgaccttttgctcaacattacatttctgagatgcatccgtattgttgcatttagttgtaggttgttcattttccttgctgtggaagattcagttgtgtgggtgtaccatgatttatgtatcctttatgttgttgatgggcacttgaggtggcttctggtttggggctattacagacagtgctactctgaacattcttgcacaagtcttttggtggacatacgaacgtacttctgtcaggtattttcctagaaggaggattgctgggtcataaggaaataggtatattcggctttagtggctatggccaaatggttttccaaaatggttgtgccaatttatattcccttcagcaggcaaacatttttgcacacattctagatgtagttgtacctgtgaaaaaattcctgtcctcagacatgcgctcccatctcctggtgtgtgcagatcacacttaattgtacgtaaataatgcacgtgtgcagactgtgccagccttcacctgggcaagtgcagaacagggtgagcctgcacaccacacgccacactccccaagccctgtcgctgggcggggcttataggaaggcggggcactgacttcctgggtctctgtcttccagaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgcctgtggggtgcgcaatggggtggccatggggacacgctgctcatgactttcttctgttcagtaggcaatttgaggtgaatttgaggaaaaaaaaaaacttccgctctaccccacctttttatttttaaaatacttttttattttaatttttgagacaggatcttattcattgttgcctgagctggagtgcaggggcgccatcacagctcactgcagccttgacctcctgggctcaagtgatcctcctgcctcagcctcccgagtagctgggaccacaggcgagtgctaccaagccaggctaacttttgaattttttgtaggaatgaggtcttgccatgtcgctcaggctggtctccaacttctggggtcaaaccatcacctgcctcaacctcccaaaatgctgggattacaagcatgagtcaccatgctggccctgcctcacttttgaggctgtttttccatcaaacctgatcactttagggagcaagggagatcagtttcttgcacaactccccgactaccctgagaggtgggactggaacccaaggctgtgctgtgagtgtgagccgcattctccagtggggagggccaggtcctctgcagagctaaggagggcagtctcttagcatccccagagggccagctttgtgctagaataaggtcagaaagagaccactgagccccaatcccctcttttctcttctgactatttctggtagtttttggcccatttagtcacatggtgggattgccagccattgtgcgttgaggacgtatcaatagaggcaagattcactaggaaaaggagaagaccatgagctctgctccatgtcacttggttcctgcttctctgggggcatccaattccagcttttggagagagcagaatggtgattattattatgggaagggacctggacaccaaccatggcttgggagggacagtgggagtgaaaataggctctgaagccacagggatggaggttcagattctggcttagccacctaatagctgtgtgagtaggtgacttcatctttctggacctcagattcctcttctgtaaaatgagagtgataatctgtgcctcctggcctggctgcgaggatgcagtgacatcttttaaaggtaggcggtagaaggtgttcagtagctatagttatcacaattagccggtaggcgaaatatctgaagcgctgtctggaggcagaggagcaggagtgttctcctggagtttctgagtcagggagacaaggtggaagggacctctgatggacagatctggacatgtgagcagatgcaggatgtgtctggaggaggtcagactccatggggagggtcacagtggatgtccttgtgatccttgcctgcctgggagctatctcaggagcctggcccctccctcacagccacccttcctctccatctctctatctcctacaggtgctgggccccaagccggctctgcctgcaggtaccgaggacaccgccaaggaggatgcggccaaccgcaagctggccaagctctacaaggtgagcaccagatgcactgtctgcctgggcatggggtcaggacagggaggtggaagacttggtcttccccactccactgctatgggaccttgagcaaagcacccctttggaggggggcctcagctttctcacgtctccagtggatgctcgtgtacttcctttgctttcctgcactaagagcatgcgatcaactccgtacatatctgtgtcacgctcatacatgaggtctctctgagtctcagtgtcctagtctgtaaagtgggaagaagagcagaatggtcgactttgtaggatttctgggagtccacagataaaatggatgtgaaaacagcttagaaaatacttggggaaatactacagaaatggtgtgtatgtggggaggttgggggtgtgggttatagttaatgactttatttatgatttctttcttgtgattttcacaactgaattcaggcttagcttcagctagggaactctcttggctgagctctgggagaaagctcaatcacacttacgttgtgccccaagtattttcagtaaaacaacaaaaaggggatgtcgattttcaccactgccaaagaaaaactactacattatcgattttttttctgattatgaagtaatacatgtttattgtaagaaaaaaaagtattcaaaatataaaaagaaaataaaagtccatgcaatttcactggtttaaaaaaccagtattacttttaaaatatgttttaattacaaaaatgacaatacccagttaaaaaatcagcctctcctcctcatgagagaacacatctttgtccagccacagctttctgtgcctagttacttttccatttccatcttattattttattttgagatagggtcttgctctgtcacccaggctgcagtacaatggcacaatcacagctcactgcaacctctgcctaccgggctcaagcgatctcttgcctcagcctcctaagtggctgggactacagatgtacgccaccacgcccagctaacttttgtattttttgtagagacgaggttttgccatgttgcccaggctggtctcaaactcctgggctcatgtgatctgcccacctcagcctcccaaagtgctgggattacagacctgagccaacgctcccggccatttctattttgtgtaactggatccaaactattcatgctgttgtgtggtcttttttccactcaacatggtcgggaatatctttctataataaatctcaacacgaccctttataacagctgtatagtattttattttatgaatgtaagaatttaagcaaatcctgattgatggacattaggatgttccaccttttccagttgcagacagtccctcttggtgcacttgtgctaagtacagcatagcactagggcaagttcctagacaaggaactgctggtcacaggccgaagaatgagtcagtagttgaaaatactggttctgggccaggcatggtggctcacccctgtaatcccagcactttgagaggccgaggtaggcggatcacctgaggtcaggagttcgagaccagcctggctaacatggtgaaacactgtctctactaaaaatacaaaatattagccaggcgtggtggcgggtgcctctaatcctagctctcctcctaagggaggagaatcacttgaacccgggaggcggaggttgcagtgagctgagatagtgccattgcactccagcctgggcgacaacagtgagactccgtctcaaaaataataataataaataaaataaaaaaagaaaatactggttttggagtcaggagtcagactacctgtgtttgaattccaggtcagctatttctagctgtgcaagttccttaaccactctgtgccttggtttccttgtgaatgagacagggatagtaacagaactatcatatgcaaggattaaaggggttctataattatacaagttatagaaattgcttagaacagtgactggcacagagtagtaagtactcaattcatgtagaataattattatttaaaggactgctacctcacagtcaactgtactctggaacagctcccaaattactgtcatcagggatcttaaatgcctgtttacccagagccttgccaactggatattgttaaacttttgaattttgactcttaagatagaacttttttttgagcttggttgaactttttattttagaataatttttaagtttacagaaaaattgtaaagatagtacaaagagttcctatataccattcactcagcttctccttagcatcttagcataaccaggtacatttgtcaaaactaagaaattaacattgcttcagtaccattaactaaactatagactttagccagatttccccagttttttattctaggttccaatccaggataccagattgcatttagctctttttacttttctttttcttttcttctcttttatttacttatttatttttgagacagagtctggctctgttacccaggctggagtgtagtgacgcaatcatagctcactatagccccgacatcctgggctcaagtgatcctcccacttcagcctcccaagtagctggggccacaagcaagcgccaccacaccttgctactttttgtattttttgtagagatgggatcttgccatgttgcccaggctggtcttgaactcctgggctcaagccatccacccacctgggcctcccagagcgctgggattaaaggtgtgcgacactgtaaccggcctcttctcttttttttgaatagtaaagttgaatacattttcagcaaactatgcagttcccctctgcacccaattccccaaattttatcccgccctcccttcccatgtgcagtttgtgttacccctgcgtgtaggtcagcagatgtggttctgacaaagcagaaaacgaaaaagaacctctaaatgtgtgcgagaggaagcccaggtgttactctacagggccatttgggacagggggtggggcaagatggtggaagtctcagggctgggcggccacagacactcatgtgctggttccttctgcttcgtcccctcaggtctccaatggtgcagggaccatgtccgtctccctcgtggctgatgagaaccccttcgcccagggggccctgaagtcagaggactgcttcatcctggaccacggcaaagatgggaaaatctttgtctggaaaggtactggagacagggaaagggtcccaactggcctgtaggatcttggatgggatgttctgcagctcccaggaactcagctcccggggagtgtggagtgtgcctggtgcaatggaaatcagaagtcttgggctgaggccttggttttgcatttgacatactgtgtgatcttgggcactttacttaccctttctgggcctcagattcctgatctgggctaaaatgggtgtttcccaagtgcattataacgtcagttctctgagaggctaattggcatcctgtagaaattatgtagaaaacatctaactgtatggtcagataaattcatgggcaacagtggattttaaaatgttcgagtttgtttactgtaggacttttaacttgttcatttacaggggggcttttcatgaagatgatctggtttgggaaatgctaagctagaagttcataaactctttcggtactatcttgtgggaattctcttggaaaccattggcccagatgtttcccagaggccctgagatgttctgagaggacccatcaatatcctcccctgattctctaaggctcatcttggggaagaggacagaggagagggaggcagtaggaggacagagagaaagggagacggtggggagaaagagagagagagagacactattatgattattactctctaggccccctgggccctgggccagctgatctggaccttggccttggcagtgagaaggctgggactgaggcccagcactggctggccaggagctccttggcacgggaatgccctcagggtggcagcttctcactcactgagtaacctaggtcaagtaatttaatctctctaagaccctagcttccttatagatactcagaaaaagataacaactttttttattacttaagactattctgtgaattaaataatctatgcatagttctaagcacaaaatacatgctcactaaatggaccacagtagtgttgtgattggtgtcactggccagccccaggctggacaccaggagctctagtgagtggtcggctctgggggtctctggccttggctgtccacagtctaagaagagtagggagggaagtttggcagctccttctcctggactgttaaaggtcaggatgcagcaggatcccgggcctctaaccctccatcacttcctctggctgccaacaggcaagcaggcaaacacggaggagaggaaggctgccctcaaaacagcctctgacttcatcaccaagatggactaccccaagcagactcaggtgagtcttggaggccaggtaggatgggaaggggtgggtcctgtttggaggggatgggctggagtagggcgggtgtcccaccctcagtgtggatggggtatctgaggctcccctggggacccctgctgggcagcccagccacatcctgctcctctgcctcccctccccaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacaggtacgtttagggcgtggggtgggtgtgtccaggcccctccctcactttccccatgcactgcctcttgcttccccaaggaggtttctctctgaggtttgcacaactttggtagctgagattctttggtgttacttagtttttacagccaatgcaccctgtgtatcaggccctgagccaagtgtcttggccccaccttgccccgaggagtgcctggtctgggaggggagttgaccatagccacagacctgtgtgatcagtggaagatgggagggagcacaggggattgtgcagacacaggaagcagtgggggtggttggtcagggcagcctgcacagagatgggaacctttgggttgggtctcagaggaggagtagagctttgctgccggagaggaagagcggagagtgatgggcattccaggagggactcgctatgttcggaaaggagggagctatcccagggggctagtgctgatggcatccccagggaggggccttgaatgccaatttcaagggtgtagacttgatcctctaaccagtgggtgctagtgaggggtttttctttttattaaatcagacatgcaacaggctcagatttatgctttatctttttttttttttttaatagagacagggtctcgctatgttgcccgggctaatttcaaactcctgggctcaagcaatcctcctgcctcggccccccaaagtgttggaattacaggcatgagccactgcgcccggccacctgctttagaaactcactgtgaaaatgggttggaatatgactccaggatatcattagaagaaaaaaatcagttaaaaaataaataaaagaaaaataaaaagaaaactaagaaaatggattggaggcaggaaaatgaaggtagagagcttataaggagcttgttctaatactgtaggggaaagatgatgaccttgagactaagaaggtcacagtggagaaggggaagaggggtgtggggttcagaggtgtttaggaggtagaatccgcctcaggcaaacttgactccgttcctaatgataggaataacaaagtgttcatttttatatattattgtttttggtttggtgctagcattcatttgttgcttcagtggctagggagaatgcaatgaaaatatttcgggtggggcggtgtggtaagacccctggcagcctgactgtgagactttgggcaagttacataacctctttgagcttcactttctcacttgtaaagtggggtttcatcccactccatcaccttcaagaatgttcaaaatccagagattctaggattctgtttcccaggacttggacgactccgtgtctccatagctccaccaggtggcgctgccgggcctcgtgaccacttggaaaaagcagtgtcaccagaacgctgcggagacctgccagcaggggtcacactgaggttgcctcgtggtgtccctgcctctgcaggtgacctatgaaattcctggcaggcccagcacagtggctcacgcctgtaatcccagcactttgggtggccgaggcgggtggatcacctgaggtcaggagttcgagaccagcctggccaacatggtgaaaccccgtctctactaaaaatacaaaacttagctggccatggtggcaggcacctgtaatcccagctactcgggaggctgagacagaaaaattgattgaacccgggaggcagatgttgcagtgagccgagattgcgtcattgcattctagcctgggcaacaagagtgaaacctcgtctcaaaaaacaaaaaaaaaaaaaagaaaaaaagaaagaatccaggcagctcagtaacaatagaggtaatggtgatattagtaagataataataataattatgacaataagagcagctgccacctacagagcagtccctttgtgccgggccctgtgctagactttcacgagtaatctcgtttgagcctcacagtactttgaggtaggtactatgattatccccatttttcagatgggaaaactgaggctaagagtggttaagccagttgtctgaggtctcatggcccggaaggggatgaggggcctgatttggggtctgtgtctggctcctcccctcactgtactgcattcctttggagctgccttgacgatcctcagcgaaggacagacgggctggggcagggcatggtatgaggagcccaggcaggaaccctgacccagagtcccagccctgccttctagtggctctgtgagttgggcaaaccatttaactccagtccgagcccaagtgattaaaagttcatcccatggcctaaccacaacctaccacactgcggtttcctggcttgcctgagctggggggtgggggtgctgcacagcatctgactccagctttgctcctgcagatctggagaatcgaaggttccaacaaggtgcccgtggaccctgccacatatggacagttctatggaggcgacagctacatcattctgtacaactaccgccatggtggccgccaggggcagataatctataactggtgaggttctggggccattggtgtgtgtcgtgggggtactggctgggccctgagcagggctgaagacaaactgagggtgtgagggcctgaggtgggaccaccactccctgctgggagaggcttttgtccacagggcaacaccatttgcttatttctccaaacaactttgaaactcttcttaccaaatgattatacatctattgtaggatatagtgaatgtggagaaacaaacagaacatctcccacaaatccatgacaagtactaggcacactagggtttatcctcccacacatatttttcaagccaaaatttttttaaatttatatttgtttatttatttatttatttatttattttgagacagagtttttctcttgttgcctaggctggagtgcagtggtgcggtctcgctcactgcaacctctgcctcccaagttcaagcaattctcctgcctcagcctctctagtagctgggattacaggcacccaccaccatgcctggctaattttttgtatttttagtaaagacggggtttcactatgttgaccaggctggtctcgaactcctgacctcagatgatccatctgcctcagcctcccaaagtgctggggttacaggagtgagccaccacacccagccccaaaattattttaaaacagagaatacatttacatggttcaaaaatcaaaacagaatataaaggtatttattgagaaatcttattcccacccctgtccctctctaccccattctccagaccccaccccttcttgggtaactgctttactctcttgcatatccttccagtaactcttcgtgaaaaaaaatacatatgcaaataatttatagcctggtccctcccttccttacacaaaaggtagcatactttgtatattgccctgcaccttgcttttctgactccattcttcctagagatcaataatgtcagtacatagagacagagagctttctcattcttttttacagttgcataatagtcctttgggtggctgtactatagtttatttaacaaattccttgatgatgcatacttgggttgattccagtctttctctattacaaacattgctgtgattagtaaccttaaacaaacatcactttgaacatgcagagacatgcctctagagtaagttcccagaagtcagattgctgggtcaaagagtaactgcacttgtcattttggtagatagcccccaatttccctcgatagtgttcgtagcattttacattcccaccaagcaacctgtgagagtccctggttccctatagtcacactcgtggattgtgtggtcaaacttttgggcgtttgccaatcttatggtttataaaatggtgtctcagtgtatttttaacttgtatttctcttactatacagtctaaaactttttgtctgattattgactgttggatttttttttttttttgagacagggtcttgctctgttggccaggctgtagtgcagtggtacgatctctgctcaccacaacctctgccccccggggctcaagcaattatcgtgcctcagcctcctgagtagctgggactacttgccactactcaccaccacacccggctactttttatactttagtatggatggggctttgccatgttgcccaggctggtctcgaactcctctaagcgatctgcctgccccagcctcccaaagtgttgggattataggcatgagccaccacgccaagctggattccttctttttttaaacttattttgaaataatattagacacttgctgaaaagttgcaaaaatagtacagacagttctcatatatccattacccaatggaatattcacctatgttcacatcttacataacccttacataaccatagcacaattaacaaagccaggaagtgaacattgacacaatactacttactaatctataggctttacctaaatttcctcagttttcccattaccgttttttttttttttttttagacagagtcttgctctgtcgccaggctggagtgcagtggcatgatctcggctcactgcaacctctgcctcccaggttcaagcaattctcctgcctcagcctcctgagtatctgggactacaggtgtgcgccaacacacccaactaatttttgtatttttagtagagacggagtttcaccatgttgggcaggctggtttcgaactcctgacctcaactgatctgcctgccttggcctcccaaagtgctgggatgacaggcatgagccatcgtgcccggcccccactactgttcttttcctgatctaggatctaacccaggatcccacatggcatttactcatcatgtctccaaagtctctgaatctatggcagttgcccggtctttcctttttttcatgcccttaacacttttaaagggtactagtcagttattttgtagaatgtctctcaatttgacaaccccagacatttaaaaacagcttaattttttttttgactagataacacattcacctggtacaaaatgtgtgagaagactgttttaaaaattagctgcatcagcgcattaataggtcagattttgtttgcttatacgacgacatatgttggttatggaaaacttagacaatatgcaaagaggtgggatagaaaggcaaaatccccctaaatcttccctctaagagcaatcaccatggacctttttggtgaacatctgtgcagacctctctgcacgtgttcatgggaggcttaatcactgacatcttttcccacaaataggctctcgtaacacttgctattctgcgacctgcttttccgcccagagaaatgtcctggccacttttctgcatctcagatttgagtctcagagcatcttctctgtggctgttcagcatgggatgacccagccagtctcctgtgggacacatttagcataaggaaatccatgcgttgcactaagatctctgtaagcgggcaagatgctaggctgagagtggaagtgttggtgtggttcctggctctcgttgttctgaaagagtccccttccctctctatctgtttcattactggtaacagggagatgtgtaggtttctcagactcagggcaagggagaggctcagggctctgtgtgcaccctgatgctgaatctcacttccccttccaggcagggtgcccagtctacccaggatgaggtcgctgcatctgccatcctgactgctcagctggatgaggagctgggaggtacccctgtccaggtgagcccagcccaccgcctctctgggctgcagcctgagccttgtccttctcttcactcatctgtctgactctcatccatccattcgtttgtccatctgtctgtctgtccatccatccatccatccatccatccatccatccatccatccatggaacaggtatttatttagggcttccatgtgttccacactgcatctgtagccatggacacacagacacactgtccctgccctagtggactttgctgtcttgggtggtagtagacattcaacacacaggcacaccaatggctatgacagatgcagtgagtgaaattgacaagaccttgggagagagacatgggagaggccatgtggctgagcacggatgtggaaccagcatgcttgggtttgaatcctgtcctcacctctgggcaacgttgggcaagtcacttagcctctctgtgcctctgtgtcctcaaaataggggtaataacagtaccatcccacaagattgctgtgaggattaagagttaacatttgtaagcatttagaatcatgcctgccatataagaagtgcccccttatacatatgtgttaagtacaaggaggtaaatcctaggtaggatcctattggattagaaaagcccacccctgtcccaggaggggactgttcaactgggacctgatgcacgtgtaggagttgcccaggcagagtgaaggaaagcacattgtgggtaaagggtggtacacatgcaaaggccctgaggtgggagggggcattgggtgttaaagcaaggggaaaatgccatgatttgaggctagagaggtgctcagaggggccagaccaccagaggccatagtgacgatgttgaccttgatgctgagaacaacaggaagttgctgaatgataagtctgaggtgtagggatttctggtttaaaaagtcactctggccaggcgctggagggcagcagagctggtttgtggaaatataggggaagcggacaacaactgtgcttcctccgtcctacggtgggagtgggcagggctctagattggcatcgggggttcgtgccctgacctttgactatgatagactgggtgctgggcactaaatgagatgatgaccatcttagctcagtgcatcctgacaacagccttgggagtagcatccttggctgcatttttcagaggaggaactcaagaggttgagacacgtgcccaagttctcaccatcagggtggagttggggtctaagccctaactcagcggtggtgggtcgtggtgggaagcgactgccatatgcctgacgtacatgtgaggttttcttctggacatagttagccggggccacggtaaggtgccgcacacagggcaggagcagatgtgagggtgtacatcttccctgcctcactcccaccaccaagcccctgactgctgcccgcatctggggtgcactggctctgcaggagggggttttctggatctagaatgctctgttcttaccactccaccagcagtcatgcccaggcctgacgtcagcattctggaagaatgtccaccagcaatccctgtgcttctatttaagggaacatttgcaaacacaggctctcctggttcttggaccaggctgaggatcaggaaggcatgtcgtcatggagatggagagcagcccagcagcagtgccctggggacctcagacaatagcactgtctccacccttcctggaattctggtgtccctgcctgtgtgttgtcgggtcacattccatgccacacacagacacaagcatgatggcttcgtctggagggatgggcccagtgcgacatagaaggactgaagcctgcccccaaggtccctgacttgctctcctgtctccctgccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtaatttccaggtcctggaacacagaagggattggcctccctgaaacctcccagctcaatgaccagatctccaggcacaggaacgggggcaggggatggtgaatgacggggtaagaagcagctttttgtattttcctgccgtggccacagggttgtctgtcttagactcccccctgtttcaaggatacccagtgtcccttgcacactttgcacagtggacagctcactacctaccattctgtacaatcagcatgccattcctgattacgttccagttgcctactatccctttcacggaggaaggcacagatctggacttgattcccaggatggtctgagcagcctagaggggaatgggactctcacctcctttgttctgggcattcaacttctgttaatgcagccctgatttttagaatcatgttggctagtcacagtgcattagtgactcatgggagtcaaccaaggccatcagggtccaaagtctgtgccctcagctctgatgggctgtgttcctccaagtccccacctgagagctagtcctgctgcggggtctcctgggctgtgaggagggggctgagggctttttgtctggttcctgattaaccaagctgtaccctcccaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccaggtaggagccggggtggggggcctgctgctgtccggatgcagctattaagtttcccccttctttccttcagcttgggggctctaaatcctcccctccatcccacctgagggcctgtcccctaatgtatgttaaataaaagcagttgcattaaaatgagggctgtggccagagagagggaggtctccaggagctaaagaaaggagagcctagcctgggcgtggtggttcatgcctgtaatcccagcactttgggaggctaaggcgggcggatcacctgaggtcgggagttcaagactagcctgaccaacatggagaaaccccatctctactaaaatacaaaattagccgggcatggtggcacatgcctgtataatcccagctactcgggaggctgaggcaggagaatcacttcaacccgagagttggaggttgcggtgagctgagatcacgctattgcactccagcctgggcaacaggagtaaaactctgtctcaaaaagaagaaagaaagaaagaaaggagagcccagtgtgggaaggagcagttggtctgtggaaggaggcggtccctcgctaggaagccttgaaaggtggtaggcagggctgatagcgtcagaggagcagtggtctccttgcatctctagactctccatggacagaaatgccaccagcctgctctgtttccagaatgtgggccgggcagctcttccttctgccagcctgcagtctttatactgttactttgagttcattcccacctgcttgatgcttaacagaaatggtgaagagtgacttggtctaaagcagctctgtccagcagaaccttctatgcagatggacatgttctgtatctgccgagtccaatttgacagccattagtcacatgtggctgttgagcacttgaaatgcgaccagtgggaattagtgggaatgaagaactgaacttttagtcgaatttaattttaatgaatttaaatttaaatggctgcacatggacagagcaggtatagtggaaagagtataggtgttagaatcagacaagatttgtatcctggtcttaacacttaccatctgtgtgaccttgagtgagttgcttaacctctccgagccacaactgcctcattagctgagtggagctaatggtcctcatcccgcaatgctgtcgtcagcctcaagccaatagtggtcctggctgtgtgactactgccaagtctgccctctctgggcctctatttcgtcaccttccaattccctcaggcctcttccctctggatctcctgggatttttaggatggagggaggagagggagagcagttggttgcgcttgggcagggctggtcccagggtccgatgagatgggagagaggggtgatggcgtcccttggcaactggcgtggcctcccctcacagatggcttctgggaggccctgggcgggaaggctgcctaccgcacatccccacggctgaaggacaagaagatggatgcccatcctcctcgcctctttgcctgctccaacaagattggacgttttgtggtgagcccctgcggaggtcacacctctgctttcccctcgggaggcgagttccacaggactggccggcagcaggggcaggagaaacagttctgatggtgtggcacagaggaaggggccccctgccagctgcagccagctgtgccactccctcagggggcagataaaggaaggccacccaggggagggaagacatctcactgatgctctttcgttccttcccagatcgaagaggttcctggtgagctcatgcaggaagacctggcaacggatgacgtcatgcttctggacacctgggaccaggtgggtgaaggacaggtgaaggctctctgtgccagagggagtgggagaaactagacttccagttctatgatcagttgctagaaggacctaaagggggcagtgccaggtgttgccagaaaagtctctaagggtactggaagtcacttcttctttctgagcttccatttcctcatctgtaaactgggagtggcggtacctcccttgcagatacactcaccttgaaagctgcaaaacgccctataaaggcaaatcacatgaccttcatcattctctcccagaccttgcaggagcgtgaactcttcctttaaatctgttggcagaggaagttgaacttagcagcatcttgtttgcaggcataaactgtccagtgtcacctagaggctctagagggctcctgcttctggtttgagggctctgggctctgtctccacttcatctcctagagaaggccattatgtaggacttggcaggggaagatgccattcacttactcaaccaatattaattgggcactgctttgtgccaggtgctttatgtttgagatgctgggatagagcaatgaataaagtaggcattttcctgctctcccagggcttacgttctcacaggggtgtcaggtcagtcacctttcctatcaaggtggcttctcccagagtcctcagagttacggagcagctggccacgaaggcataagactctacactacccacagggatgctcggaatccccagttggaagatcgggaccaaaaatgattgcagcttgagccattcagcagttgtcattgattgatccattggctacttaatctgtttgttcatctgttagggattcagtcagccaacatttattcagcaccatggtcttgcaggcaaaatgctgagtgctgagaatcctatgatgagcaaaatagaatgcctgccttcgaggggcttccactttagttgggaacacatttataaataagtaagagagggccagacatgttggctcacacttgtaaacccagcactttgagaggctgaggtgggcagatcacttgaggtcaggagttcaagaccagcctggccaacatggtgaaaccccatctctactaaaaatacaaaacaattagccaggcttggtggtgggtgcttataatcccacctacttgggaggtcgaggcagaagaatcacttgaacccaggaggcggaggttgcagtgagctgagatcatgccactgcactccagcctgggtgacagagtgagactccgtctcaaaaaaaagtgagaaaaatgaagtctgacattttattgtctaatgccattttatcaatgataggtgctctttgaagtaatattttagatatgcataaaaatagatgatacataaaaatcagctaaataatgtgtaatagaacttgtaacaagactcaaaatggtgatagtggtgggtgagttatttttattccaagccttaggcccattttgacaaagatgcacacagaccggcacatagtagactctcggtgcatatttgttggataaataaatgggtgagaatatgtttggccactcatttgttgaacgagtgaatgctgttcaagagataactcatggacctttagagaagaatctcaaactcaatgcctgatggtacctggttggcaatgttagcgaatgaagcaggctgggctggggagacgtgaaggagcagtggagtctgaggcaaactagaactgctcatctcaaaggggcagctcctgcgcagcttgactcaagtgaggtttgaaggcccaggctgctagatcctccaatttttaaagagaagttggaaatctagatttttatgtcataacggtttaaaaagacattgttggctaacacaaggtggtgggtgagcaaacaaaacatgtttgtaggttgccagttttcaacctctgttccaaatccttccagtcttagttcatgggctctgttagaaaggggagggctttgtctggtctgatacctggcccctccccagtcttcctccagccgtgaatttgatcagcactcctcatgtacctttcctgttgcatctcacctccaggtctttgtctgggttggaaaggattctcaagaagaagaaaagacagaagccttgacttctggtgaggacccgagtgcctgggggcggggggaggggtccgttgcttgtggggtgctgggagtggctcctgtacaggtctgggaatgagcatctttccaggggactgatggacaagatagggtggggacttcctcctctgtgggccagcccctcataaatcctgcctgggatagtgaagaacacatcagttccttcagaaaccctgaggcttctcaaagaaggctctcctctgttccaggagaaggaagggacagatgagaagtcacttcaagttcccagaatactcagaagctgaacttgtcaaggtttagatgtggcaaagcaggccaggcatggtgactcatgcatgtaatcccagcattttgggaggccaaggcaggaggatcacttgagcccaggagtttgaaagcagcccgggcaacatagtgaaacctcatctctagaaaaaatacaaaaaaattagccaggcgtgttggtgtacacccgtggtcccagctactcaggaggttgaggtcagaggattgcttgagcccaggagttcacggctgctgtgagccatgatcgcaccactatactgtagcctgggtgacagaatgagatggtgtctcaaaatgaaaaaaaaaaagaaaaagatgttgcaaagcagattcttggcagctgaatagatctgatttgtgagctgggaacccaaaagttggttcccatatcttccagtaggggactgcaagggaaagtaataagctttatgaagcaggagattaagccgtagccctgttccttcctgtgttcctgagcagggtggtggagagcccacgtgggtatcatgcctttaaaggaggatggtgcccagggcagggggtgggcagtagggacagtaggaccatagaccctcttctttgtcaactcctgtcctgagtcaccctctccctggtgtgggaggcactaagaattcctggggtttccttttcttgcacgtgtgtctgcagctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtgtactctagtgtggctcgtttccttgtgcccatctgacagtgagagccggcgtcttctctgcctgtgtccctggtaattctgagaatggccagagaggtgcctagcatttgcctgtaaactagtagaaaggctacatccaccctgtgcgtgaatcctggtgccctgagaggcgatgccacagtgagttgagaggtgtgtagattgtcctgggggatacctatgctaaaggaaataaggaggggccgggtacggtggctcacacatgtaatcccgacactttgggagaccgaggcaggcagatcacctgagatcaggagttcgagaccagcctggccaacatggtgaaagcctgcctctactaaaaataaaaaattagccaggcgtggtggcacatgcctgtaatcccacctactcgggaggctgagacaggagaatctcttgaacccaggaggcggatgttgcagtgagctgagattgcaccattgcactccagcctgggtgacagagcgagattctgtctcaaaagaaaggaaataggtggggaaccaaggaagactgggagagccatcagaccctcgacgcaagtctgaccctaggtggagaaaaaagggagagaaggttgtgcggaagtgtcttagtggtcatttatttaatccaggaagatttggcaaagcttgtcggcagtcccaaagccaaattcagtgttctttttaaatttaatggtatagtcccatttttgttgttttttattgtggcaaactgtacgtaacacagtatttattttaaccacttgtatgtatttcagtaacattgcatatacagtgttatgtagccatcaccactctctgtacccaaaactttttgataatccccaatataaatgctctgcccattaaataccaattccccattcttccctattcgccagcccctggtaacctgtattttactttcagtctcagaatttgactattccagggacctcatataagtggaatcatacaacatttgtcctctgtgtgtggcttatttcacttagcagaatgttttcaagactcatctgtgttgtagcatatatcaacttttcactcctttttgtggctgagtaatattctactgcatgtctataccacatctggtttattcagccatcaatggactctttgttatttgtgccttttggctattgtgcataaggctgctatgaacatgagcatctgttcaattcaaagtgttcttgagccagagtcaaagtcagccagcaaaggaattgtgtgtctcttgtaagcaggcgtgccttatctgccccctgcactcagtctttgggaggcctggccttgggacacatgtgggatgaagttcaaagccagcagtcggagcccttatcaattatatgccctgcagtagaaagcgggcagggtgcatcctcatagctgccacatcctgtagcagctgcttggaccttccctgctgcctctgtttcccacagattcattctgctgccccaaagctatgtggagaaataactgcagcagctgccagcacaagagctgcccccggatgctctcaaagtttgcggtcttcagggtatgggaaagggactcttctgtgccttcttggtcccctgggtcctgactctccactcatgctcagcatgtcacacagtccctcttggatatttctatgttgtttcataatcttttctcctgggagactaaaccagtccaagaaacctgctggaggacattccccagtcctcccgctctgtccttttggtctcttctcaccttgttttccccccgtcttgttctgtgtcacctcccaccaccactccatccccattgagttatgatgtgaaagctcgcaagcatatgactgtaaaagaacagaaaccagcatgagggcttaaatgatgggcaggctgtgtgtttgtgtgtgtgtgtgtgtgtgtgtgtgtgtgtgtgtgtgtgtgtgtgtttacactgttgtctccaaagctggctgatcacccaaattgcccagggaactttttaaaagcatggattccccaagggccattcctccagagattctgattcatcgcagaagtgtcgagggtagtggagaagaaattttctggatgaaacgtggagggaagatgaagtcactttcaggcagagggtgcagctagtacaggcagggggctgtgaggggaacagcgtgctcagggacagacagcagcctggagtggcaggcctctgagctgagaagcaggctggggctttgaatgccataccaagggtttggacttgatcccataacgcttgccttgcctacccccaaaggtttgctttcatggtcaaagcaatcaacttgacaaagtcctggtacagaagtggcatttaccacccaaagcttctagggctttcacgagaggcaggtagaggcctgtctagacagagctagcttacttcctagaaattagtgggaggtaaaatttcaggtagacctgcccattaattcttcatttcagtttataccagcattcaagggtatggctgtggcctcaaaagagagttgtgcaatgctctgagaaagaaaatagcctggggccactgagatgctgccttcttatttttctctcaaaggcagaaaagccaatcaggagcactatcacttcaaccgcacattttatctttctaaagttgcagacgtcatcgtctcctacaatggaaaaatcatcgtgaaataatgagacagatgccagagggacaacgctaggcttggatcttgtgtccaatcttgggcaattcagttgaacagatattttgtacttactttgtgcaaggcattatagatataatacttaaacttttggagcctcaagttacccacctgcaaaatggtaatgttgtattaatacctagctggaggtggtataatacagtggctaatagctggcttttggagtcagacctcagttcaaatctagctctaccactcattagcagtgtgatcttaagttctttgccatttccttagctgaaaaatgagaataagaacagtgtcaccccacttagaattctcatgaggattaagggaggtaatgcttagcacaatgtctggcctatagtaagtgctcgaaaatggttaaaaataatgaaagcacctaggccacagcagaacctagtattcaaccacggaggcaaaggcccaatgtactgtggatcagaaaggatgtttttggctgtaagcagtggagggctaactcaaaccaaattaaactgtaagcacacttatgtgctctcatacataatcagttcagagttgagggggacttcatggttgactaaacgtagtgggcctgagtttcctgctcattctcttggcccttgctagtctggtagtaaaatatctgtaggtgttctggttgctccacacccatgaacagcaatgcccagaggaaaagaggactgtttctagaaaagttttcagaaaagggaggaggaactgctcccaagaccacggaaaacctttcctcaggtctcaagaatccatattgggtcacataatcattcctgatggaatcatgggctagaaggatggaattattcataggccagttaggttcatcctagcaggtgggggtgaattcttctcctgaggtcagagcgctcagggggaggtatctgaacaaagtcatggctcctaggaaggagggaggagataaatggatgctgggtagaccgccattttgttggagacttctgggggccagatgcggaaaattaaaagtaatggctccttacagttctgtggcatccagtaattaattttcagactgttcaatttccagtcattttcccccggaatcttttagggaagatttgcagcctgcattatgattactatgtttctagagtttattgtaaaaccacagttttaacagcggcttcaatttcctttctcactaaactcttctggctacagggtagattgaaaggggctgtatcctattagccagtgtgactggtttaggcaaatcctagcttgatctgagcctgggtctgctgtagacctgatgttaacaacatcacaggaagagatcatcactaatatccccggagattttcctgtggcctggtcaacacagccaaatgagattatgcatggacatgaaaaaagctgtgtaaagtgtcttgcacagtgctggcattcaaccgtggttccttttgccttcttcttggttcctataaagtaaaaactcttcaggtaactgcatagctgtgtagttggatcttagacatgatctagcccaggatttcttaagtctttggataggtttgggagtggggccagtgtacccccaaagcatccaaatttgtgttgtgcacactatgtgcagttttcagacgaagctctgtagcttccaacacattctcaaaaggtctgagacccaaacagctggactataatctccctgttttacaggtgaggaaaatgaggctgagagaacatatgacttatccaaggtcacattataaagtggatgctatagcaaggaaagcactccagagcagtgattttcaaacagaaatatgtagaattctatgaggtgcttctgtgattttgtaaatattagattcaaattccatgtttaaagtggtaataaaaacagacaagcaaaatggagaaatcgaatgtagactctgaatataagattggaactctttcgtaactctaatattgtttttcaaaacagcctcattgttctcattgagttactttatattcagtaaatgttataaatgtgaactcaagaatttatcctggcaaaagacaccgtaaaccttttactgatgcagttacctttgaaaaaaggggtttgctgctgaaagtaagaggaagaggcacttgattcactatttactagccaagtaactgtgagagcaggtttgtgagtatcacaagaaatgatatattttaaaatgctacataagctgagagtctatggaacactggtttcctcctgctcaggacagtgtgttatgacatttgtggttacaaatgcccaatcgggccgggtgcagtggctcacacatgtaatcccagcactttgggaggccgaggtgggcagatcacctgaggtcaggagttcgagaccagcctggccaacatggtgaaaccccatctctactaaaaataaaaatacaaaaattagccgggcgtggtggcatgcgcctgtagtcccagctactcaggaggctgaggcaggagaatcgcttgaacccaggaggcagaggttgcagtgagccaagatcacgccattacactccagcctggatgacaagagcgagactccatctcaaagaaaaaaaaaaaacaaacaaatgcccaattgactctcctctttttatagtgaactttggctgaattggatggcccaaaacaaaagtttaagtttagggcccagttaggtgtgaatgtaaagacaaatgaactttgatagtcttgggaaaagttgtgatctatctacaaaatggtggtggtggtgtgtggatgggggcactagaggcaggcagtgtcacacgaagatacactgatacacctcacaaatctttggcattagacagatctgggtttgaatcccagctctgtttctttccgaccatgtgactttggctgttttaacctttgagccttcagtgtcctcatctacaaaatggtgataataaagtgtctatcaaaccattttgagataaaatgatagaatgtacatacacgtatttgtgcacagagctgagtgactggtgctcccaaatggtagccactaattcaagacagttctgtcagatgttgcaggtaaaacacattggttttttatcattatttgtttctttttaagtaaaggctatgtctatgtgattaactgggtgacagcaagaagtgggttcctgtcctgtttggaggaaggcaaaagaaaatgaagtcagttaaagctttgtggtggtggtggagggtgtgtgtggatcttgaaactccccagggaaaatgtgtgggccagtgcaccagagggtgcctggacctgggagacagcagatggcccacagcagcctgtccccttcccctggcccacaaagcacacgaagaagccaaccagccagctcagaaccggaggatctaatgtactacttctgaaaacggaaatccacagacattcaatacaggccgaaacagactctcaccccaaaaatattagtgaaagtgcatacactttattatgtacattgttggaaagggaggccacctggagaaacttctgcactggcactgtgttcctagagctccttctatgcgtccctcccaagtgatttaatttcagctgattggactacgaattcacaaggcagaaaagtcaaggtcatttggtatctggagacaggagaactcaaggaaccaaaagcactgttactctaagtctcagaaaaggttttcagtcaggatatggaggctcctggtcctcaagggtgaaccacttcacacaacagataaaaccatcattttaaaattcaaaatgtaagtgcaacttgagtttaagttgcactgctccatacctctaataaactcagctaggagccaggatacatggtagttcaaggcttcctaaaataagcttgaaattggggtacaggggaagggacatccattggctggatggacagagtggttgagctaaagagagctataaaggctcgtgctgggaaagaaagctgttatgcttagacttctctaggtgaactcagagtctcaaagaggaaatgttacaaatgtcacccgccagctttctggccagtaagcagaatgccaggttgctcagattcacagacatttgcaaaacagaagatgtctcctaatattatagactaagaatttgttgtccagaggagctgaccagttcctctttcagcatcaatatacatgatagaagaatgactaggtaaatttaaaaagacctacatctatatagatattgtaagtttgacagtatctgcccaagatcattagacactatatagtcaatatactgtgaattccttatactatgtaatgaatgggtttgtaatcaacatatttcacagtgtaccacagttaacagcatgcagatagtaaaatataatggtttcctgaagttatctcttaaaaaagtattttagtccttcagctattcaaatagatatataacaattgcatatagaacgtagagaaaattttattaaaaaattaaaactatttaaaacctgatatatgaaaataggcaacagtgagaaaaaagcacttttgtgacaaatatttagctggtttgaaagacagaacaaggaggaatcatttactcataaagaaggctcaaataagttaaaacatggatgtatttttaaaatgaccactctagtagtgaatttaaaagtcttttaagggttagagtaatctttttcattagtcttggctatttcctctagttctgacaagtacaggcaagaaaatggctactctcaagtaaggattattctgaaacacggtctggatttagaaaataaatgaacattagggaaatttccttaattaagactctccaaaccaggtgtggtagctcatgcctgtaatcccagcactttgggaggcagaggtgggtggatcacctgaggttaggagttcgtgactagcctggccaacatggtgaaaccccgtctctactaaaaaacaataataataatacaaaaattagctgggcatggtggcatgagcctgtaatcccagctactggggaggctgaggcaggagaatctcttgaacccaggaggcggaggttgcagtgagccgagatcatgctattgcactccagcctgggcaacaagagtgaaactccatctcagaaaaaaaaaaaaaaagactctctggaggtaaggcacatatgacctggagaagctggttgtggtgtaaggtcatcactttctgcaaagcatttagccagtcagcggtgtcaggtggcagttacagcccaggttcttgcctctggcctgggtgcttagggggttcagaatgagtcagtggaagtcaaaacaagagggatctaacctactacataataatctaaaaatacaaacttttaactattttaagactaacagattaccttatataaatcaccaatctctcagtatttacaagctaacaattctttcacctatttttataactgctatacattctgggaacaccacaattgacatatggaaaaagaaaagccctaccctctctttatgagttaaaggctaatttggtccccgacttcatgcttggaaggctagcgctcatctctacactagcctagatggctgtgttttgcccctatgattccttgcagcatatctatgggcagagggaagacaattgttgagtttttctcagcagcaatggtggtcagtgtctgcaggtatcggagctgaagggctgcaggagattcagtgatgaccatggaggcttctttcagagccctggatgcattcatttctccttcggctgcaataacctatggacaggtgaaaggaggggttgaactggagaaaacctcatggggacacacagcactcttcaaccgggggtatgtatacctcaggtggtccacaaaactttctagggcgtatgccagagtagttttaagaaaatcaatttctacatactcagtttccatatgcttctttttctgaaactgacttgcctgactagtgcctggatcaagacattctcttttactatagcctttctcccattttccagggtaacaaacaaagggataattcaaaatactgtgcaggattgagaaagcaagtaactttaatgactgcaggcaaatccttttgcaagtcagcagcatttccaattctctgatgagtaccttactaaactgaaagctgacaggtcattataaatattttttgatgaaagactgtgatatgatttttttagcacataaattcaaagtgctaagaactgtatgatactactttaaacagaacttccatttccatctacttatttatgtaaataaggtttcaaagtccttatagctataaaaatgaaaaataggaataaaattgatgctgaatcgtgtctcattctagcattaaacaacagccatctatacatgtacgatttaattctcattcatcttataaagacaagcatttctagtaaaaattgacttctggtactgggtgcagtggctcacacctgtaatcccaaaactttgggaggccaaggcgggcagatcacttgaggtcaggagttcgagaccagcctggccaacatggcaaaaccctatctctactaaaagtacaaaaattagctgggcgttgtggcaagcacctgtaaacccagctacttgggaggctgagacaggagaattgctcgaacccgggaggttgcagtgagccgagatcatgccactgctgcactccagcttggctgacagaatgagaatctgtctcaaaaaaaaaaaaaaaaattgacttcttatttaggagaaattctgaaatgtttgtagaaccttgtttttagttacaggaaatttttaaaaattaattctaacttatggactaaatatgttgcagtatgttaataaaataattcatgacaaaatgtatgttaggaaaagaatctggcggaagtgaagatgcaataaaaaacttaggtttaagaagaagaagaaaaaaacaataaaaagctcctgactgttaagagtttacttacatatttttaatggataactaaatcattattatttctcattgggtacatttaaaagaatgatgttaacagttttatttaaaaatgtcaatatttacaacatgccaggaattatattcttggcaagtacataaattcaagatgaaaaatttttacatgccgatttaaaatgtttgatggactttatagtttttctaaattctgtaaggggtttcac

SEQ ID NO: 81 - DNA, 21300 bp, Homo sapiens
tggcattagttcttacaggaacgttgaaattaaaaaatactgtacaaccatcttctcaaatgccagggaatccaactttgcaagccaaaccagttgtctcaaattcaattataagttttccttctgccaaagagatatgttttctgtttaaagtagactggagcccatgctccatacttgatcagatcactgtaaagtcaatttagctgctgagaactagatattggcaatctagagtgaattcacagagaagtacaaactacctaatatttaaaacacaggaaagttatcgaaattggacatccttccaagattttttcacccaaagaccatcacagacgtaagtataatgttagttcatgaaaattattaaaagccttgaacaacagttcagatgacaaatattactcaatccagctttactgcagtgtatactgaattggattctaagcaactccagtgaaagtattagagaatatagtaaatagatgatggatttaacaaaaatactctgtgctgcttcctctctgctttttaaagtgaagcctagaagcaatctaagtgtccataaataagggcttggttaaataaattatgatacattcttaccctggaaaatgcaactattaaaaagaataaagtagaccctagataccgatattttttttaaaagtccatgatacatagttaagtgaataccacaagttgcaaaacatgtatagaattattccattttgattttttaaaatctatttttaaataccctgtgtgtatgttcatatatgcccagcaaaaacagctgaaaaaagatctgacaaattgctaacagtagtaacctctagggactgactgaaactaggaggcagtgaaggagtgactttccctttttcctttgtggacttctggttgtttatatttttttgccagtaggggttacctttggggttgaaaaataacaacacaaaaatagtaaaagtaaaataacatgaattacacagatttatttatcagatactaaccaaagtaagtgatctttctacttaaatgctactgtatgcttaaaactccagagaatctaattcattctttttctattatattttactaaaacaaataaaaatcaccccaagtccctactagttttctcaaatgctttctatacatacatacatacacacacacacacacacacacacacacccacaggcctggtcataagcatagctaacacacacggtgcttattctacactaggaactgttgtaagcacagtaagtgttaacttatttaatcttcccagcaggcctggtgaagtgaatcatgcctgaaatcctagaactttgggaggccgaggcaggaggactgcttgagttcaggaactcaagactagcctgggcaatatagtgagccctcatctctacaaaaaatacaaaaaattagctgggtgtggtgacccacgcctgtagtctcagctgctcaggaagctgaggtgggaggatcgcttgagcctgggaggcagaggttgcagtgagccaagattgtgccactgcacttcagcctgggcaacagagccagaccctgtctcaaaaaacaaaaacaaaaacaaaaaaagtcttcacagcaaccttatgagttaagtactactataatattatcttcatttcacaatcaaagaaactgagtccaaagagcttcagtgagccgcctaagcttacacagctaacaaggggaagagctaggattcaaacctaagaataaactccagagtccatactctcaaccactatgcttcctgtctctcagtaatatgtcaatctctctatatgaaagccaaaaggggttacaggtaaaacccagctagctaatgcattccttgaagctggaagagatgcacacttggctttttatgggtgaataatcctacttatgtcattgccaagctccaacccaaggatcaagactgtattaaggttcataaccatgtgggaaaattctctacacactcaattatagtccaaagtccatacctgactccacagtaaatcactaagcctaagatttaggtcagagacccagctagacaaaggatttggacaaacctccaccccaactcaaagcaagacaattcagaaacttttgtccaaacgttctgacaaagtaggcttttgttttgttttgttttagtcctaggcccacttaagatttaaacggggaaagaatacgagttgtctttaactttgcttgaagacttcagcaagaaaagccttttctacgtgggctcaaacagaaattggcatatatcagcatcagcaaagttgaacatcctggcttaaggagacaaaaataggcatccttgcttaaatggtgtatttggccaaacatgttgaccttataattgtggaagaaaaaaatggtgcgaggaagagatttaacctaatttgtaaatgtgctcagcctagatacacacctgtcccaaatgacctactgaatccacttatttgcagggacaacatggattacaatgccttttttgtttttattttttgccctcaagtggtccatactactgtttgtaaacaaaatcctctcactacctctcttccacctgtcatacacacacatctgatatttacataaacaagaagaaatgaacagggaaactggagctttgggaggaattccttaccctcagcttttgacccagtggttgaaggaggtactatgcgggctttcaaacttccccaaataacccaggcagagaggctgggtgcgcgaacccaacccaaaagtttgcgcccattctggtctctgaaaaaggccagaaagccctgttgggaagaagatgagatgccttccacccagcagccaccccctcccgagggagcacagcccacgggggacaaaagactttccagattgatcgggggcgggagggagactagctggacctgggatcccccctcgggagccggaacctggggtgtctttggggtaacaaacgataaattataggcaagagcccaaccctagattgccggggctgaggtgaggacgggtcctgcccgagagggagcgccggactcacctggaggaggcgaagagggggcctcggtggcaggtggggtggggaggacgctgctgttgctgctgctggggagatcgggggtcggggtccggggagtcgtgggcgccggtacggtggtcgctacaggggtggtcggcgccgggccagtggtcgtcgaaagggtggtcggcgcgggtctggtcggcgcctgagaggtggtcgaagtgcgttccgccgccggaggggtggtcggcgaggggccgagcggcgcctgaaaggtggtggaagagggtccagcagtcgcccaaagaggggtggtctccggggactgggctggagaagtcgcagccaggggtcggtggacggtggcgcgcgggggcccggtcctcggggcctgggccgtgggagccgtcgccctagggaaggggtggctgggctcgccccgcaacccggggcccggcgacgcgtccacctgccccgcggccccgccgccaccggtgacattccccgccgaggcggctgaggcgacggcggcggcggcggcggcggcggcgcagcacaacagggcgaggccgcccaggctcggcaggctcctcatggcgcgctcggctccgccattcattcattcagccagtcggttggtcagtcatcttctcctcgttgcaatccgaccaaggaagcctccgcaaccgccgccgccaccgccaccgggcgcaccatcgccacctccctctgacaggcggccggccccgcgggcgggccccagcgcggagggagcgaccggaccgagcgcggaccgcccgccctcctcgattggcagccgcgcctaaccaatgggaagccacagtcgcccacgtgatccgcccgcttcccggcctctttgtagccccgtaggccaatcagaggacgtccaggagagggggcggtccgtgaggcgggagaagggtggtgcgagcccagctctagcccgccgggctcgcggcggccccggctttgtctgcccaaagagtggggcgcgggcctcgggcaccgggcgccgcggagcagacaaaggatgcgccccgcgcggcagacgccgggcctagtcatctgctccaccgggctgcgagcacgagcggggggtggaatcagcactcgggagcatccccgccctcctgaacaatggggcgccagcgccgcaccccagctcgggcggggaccgcgcgggaaccccgcgatgggagagggcagcggcagcgacgatgtagagcttggcatgccctctgctgctccagagagcctggtcgcagccttgcgaggtctctgccgccattcccatttcagagatggggaagctgaggcccttgctgagggcctccctgaaccgagacccacgccctcaccagaaacctgctgtgggccaggtgttgtgccagactggacaagggggcgggaccgggcggtggagacccctgagggcagaaggtgcaagcttcctgcgtggaggagacaggctcgcaagcacacttacctaaaccccgggaagaataggatcagacagggttgaacctcaacttgatgtcttttgctgaatggttttgtggcctgagcgcggttttttcaccactaaaatggagatgataggacacccctcaccccccacccccctcacagagctgttgtgagaattaagtcatggacgtaaagggcttagcccagagcctggcccactgttgtaaccctcattaatgctaactattctcagcatttgcgccagggcaagcccaggattagaaagcagccccaggccacagcccttcagtgcccccagagcctccggctggttgcaggggttggggtggggctaatagccgagcttgaccctggatgacactaaaccctgaatcaagctggaattcgggcacgcagcctcgcatcatccgcccaggatccagagctaggtcaggcgctgctgcttcggctcagcagcttccagaggaagccaggcagggcgggtttgtcatctgatggggcttaattcaagccccactgctaacccaatcccggcctcccctacgtgatgtttggctttgtgcatggtttcccattagtcattggtcttcaaccagaccagcaggatgagatttatgtgtgaacccgtgtatgttaattaaagcatgcatttattttcctgcatgagtagtgggtgggggaggctgtgtatgaatgcataaacatgtttgtgagtctgtgtgtatgagtgttgtatgtatctgtgtgagtttatgagtatgggagctagtatctattttcatatattgtgtcttaataatctgtgcatgtgtactggtgtgtgtttttgtgtattttctgtgtttttgcatttgtggttatctatgggtgtgtcttgataggtctatgtatataagacagcgggaatgagggagaatgtgagtgttctgtcttcaggaccaatatttagcaagcactaaccaaggttctatttttactttgctttgggagggtggacaggtcatgccagtcccccatattcccttgctgaccctccctggcccttcaaaccccaaccaaaatgtcacattctctaaaagacattcctggatttgagtgggaattaatctctcccttctcatttccccaccaccccttgtttatgcattgattacagccctgatctaccaatctacctctccgttgcctcttcctaaaaggattaaggatggctttcagaaatatatacaacaggataaattgtattgcccacatggctttattacttctcataggcatgcatcagccttaatactagaacttgttatttatgtgtctgtctcttacgtcagatgttctccctgttctgagaacctagcaggggcaacacatgtaagtgccaacccatgctggttaaattgaattaattgaggtcttgtcgtgcttgtgggaggagcttgtgtctttagagtcagacagacttgggtcatgactgccaactctgtgaccttggaggaaacctttcacctctctgagcctcagttttcccccccacttttttttttttgagacagtgtttcacccttgtcgcccaggctggagtgcagtggggtgatcttggctcactgcaacctccgcctcccaggttcaatcgattctcctgcctcagcctcccgagtagccgggattacaggcacttgccaccaggcccagttaattcttgtatttttagtacagacggggtttcaccatgttggccaggctggtctcgaactcctgagctcaagttatcctccggcctagacctcccaaagtgctgggattacagacatgagccgccgcgccaggccacttttctcatctattaaatggggccaataaatagtctctcatttgttgactaggattgaggagaatgtttttacagagcctagcacacagacggtgctcaagctgtgtaggttcatatttttgttataccattgctaactttgagacttgttggctgaaggaccagagcagaaacccctgccccataagttccccatcaggtgacatggcctgacacttgccctacctgatatttccaaatgatatctgaaaaatgctgggttggccctgagctttgctgtatcagaggttctctggcaaggggaaaaaagctgatgcagcttcttggccaggagagccacagagcaaatgactaggagaccttgtcgagtgattcaggtcagctctctgccttaggcaaggatcatccatgccggggcttttaagatgggatattagcctgtcatatgtatagaaaatattgaatttttttgaaagataccagtaatttaaatgtgttaatgtccattcaacatttaatttttaaatttccttaatcttaaatcttccttaatctctaaactacaagatgactttcttaggaattatgtttgtgtttaaaaattggaaataccttacatatctgtcatcaaagaaaggtattattatacctgttaaatttaatcctagaaagtcattgtaagtgtagctatgaagacagtatagcaaatattaatagtaaataattgagctcatagtctatgctagacactataccaagagctacatatgaattgttttgtttaatcctaaaaaccccaggaaataggtactattatgtcttagtccatttgggctgctgcaacaaagtactgtagattgtggcttgtagacaacaaaaaatatatctctcccagctctggtgcctgggaagtccaagatcaaggcaccagcagattcagtgagctccctgggtgtcctttaaaaggacactaattccattcatgatggcgctgcccttataacctaatcatctcccaaacgcttccaaatacttttacatggggagttaggatttcaacgtgtgaattttagggggacacaaacattcagtctatagtctattattatctgcattttacagctaaggaaactaggtcacaggttaagcaacttgcccatggtcacttagtaaataatagagctagaaatcaaactgaggctggctggctcccactgacacccttaactataaatggaaaatcctcataatggtaagaagaaaagaaaaaataaaaattatagctgtgacactctgtgtaacagaacattgactggcacttttcctatttgccccagaactgtagctaaggcccatgagacctggagccaaaggcttagggaaggaccacagaacagcaggggtcagagtgggccttgttggagccaatgtgcagcctgacttttctcctaggcaaatgaggtgctctaaagggccccaactgatttctcactttattagtcagcaccgagcacagtgtcaaatacacagaaatggctcaagaattgtctgtgagccaggcacggtggcttatgcctgtaatcatagcactttgggaggccgaggtgggtggatcacaaggtcaggaattcaagactagcctggccaacatggtgaaatcccgtttctactaaaaatacaaaaaagttagccaggcgtggtggcggacgcctgtaatcccagctacttgggaggctgaggcaggagaattgcttgaacctgggaagcagaggttgcagtgagccgagatcgtgccactgcactccagcctgggcgacagagcaagactccatcttgaaaaaatttttttaaaaaattgtctgtgaagtcttatgatgtggcagatgctgttccgggagttttatattcggaacacgtttattcctcaaagacagggctgtcatctgcacttcaaagaagaagaaactgagcctccaagagcttaagggacttgcccaaggcccttgtgactcaaaagcccaggctcttctctatacactacagtcgttaatgtggccgctatgtgttgcacatactaggaggtcagtgaacacatactgaaggaaaggacacacatgcaccaaatttaacccttctgctagaaaagcatttaagaaaagagaagctttgggagtgagaaaagaaggtataatgatatgatacatagggctcagcaaaataacttcatctcccagattccaataaaacacagacacctttcccctttctggtttcattgaaacagcaatgctgacatggactatttctaatcctgctggaggctggcctcctatcagatgtggctaaatgcaaggtttggcatcttctgcagacaactgtaggattactggggccactgttcacaaagtcggcccagcaaaggacactaacagacaagccacagaaaggaatacaaatgactaaaaaatatgaaatactgcatatgcaacttgagtaattaaagcattgcaagttgagataaggagttgccatttttttaacctattgatttggcaaaaatttttacaaactggtaatacttgttatggtctctcactgttgatagaaatataaagtgatacaacctttccagaaagccttaaaagtgtttatactctttgacccattatttccactttttttttttttttttgagacggagtctcactctttttgcccaggctggagggcaatggcatgatcttggctcaccgcactctctacctcccgggttcaagcgattctcctgcctcagcctctcaattagctgagattacaggcatgtgccaccatgcccagcaaatttggtatttttagtagagatggggtttctccatgttggtcaggctggtctcgaattcccgacctcaggtgatctgcctgcctcgggctcccaaagtgctgggattacaggcgtgagccactgcacccggctcattatttctacttttaataatctagccaaaggccaggcacaggagatcatgcctgtgatcccaacactttgggaggcttaggtgggcagatcacttgagcccaggagttcaagaccagcctgggcaacatggtgaaaccccgtctctactaaaaaaaaaaaaaaaattactaaaaattagcatggtggtatgcagctgtagtcccagctacctgggaggctgaggtgggagatcacctgagcttgggaagtcgaggctgcagtgagccatgatcatgccactgtactccagcctgggcaacagagtaagaccctgtcccaaaaagagaaaaaaaaaagaatctatccaaaggaaataaataatcagatgtaaatatgtatgtacaaaaatgttcaccagagtgttatataattacaaaaattagaaaaatctaaacagttaacaaaggattagttgagtactttgtgctgtatgatgtttctatgtagaaacactatacatctataaaaaatgatactcacctgcctagcactgcctgcccaacactgcccacccagtgcctgtccccagactatggcccagccccctttgcccttgtccatcaaaggtgccgccagcatgtctgacaaactgccctacaaagttgctgacatcggcctggccacctggggacacaaggccctagacattgtggagaatggatgccgggtttgatgggcatgcaggagctttactcggcctccaggccactgaagggtgcctgcattgctgactgcctgcaaataactgtggagacggccatcctcattgagacccttttctccctgggtgttcaggagcagtggtctagctgcagcatcttctccacccaggaacatgcagtggctgtctttgccgaggctggcatgccagtgttcacctggaagggcaaaatgaaagaggggtacccgtggtgcattgaacagacactgtacttcaaggacgggcccctcaacatgattctggatgatgggggtgaccttaccaacctcatccacaccaagtacgtacccacagctcatgtcgggcatctgaggcatctctgaggagaccaaaaccggggtccacaacctacacaagatgatggccagtgcaatcctgaaggtgcctaccatcaacgtcaatgactccgtcaccaagagcaaaatttgacaacctctatggctgccaggagtcccttatagatggcaccaagtggaccaagacgtgatgattgccagcaaggtagcagtggtagcaggctatggtggtgtgggcaagggctgtgcccaggccttgcagggttttggggcctgcataatcatcaccgagactgaccccatcagtgcactgcaggctgccatggaaggctatgaggtgaccaccatggacgaggcctgtcaggagggcaacatctttgtcaccaccacaacctgtgtcaatatcatccttggccggcactttgagcagatgaaggatgatgccatcttatgtaatactgaacaatttgacgtggagatcgatgtcaggtgcctcaacaacaatgctgtggagaaggcaaacatcaagcccaggcggactggtactggctgaagaatgggtgccacatcatcgtgctggctgagggttggctggtcaacctgggctgtgctatgggccgccccagctttgtggggagtaactccttcaaccaggtgatggtgcagattgcgctgtggacccacccagacaagtaccccattggggttcacttcctgcccaagaagctggatgaggcagtggctgaggcgcccccctgggcaagatgaacgtgaaattgaccaagctaactgagaagcaagcccagtagctgagcacgtcccgtgatggccccttcaagccggatcactactgctgctgagagtcaggcctgcccttcactttccagctgctgtccttgctcaggccccgcctcttctccctaagagcaaatggcaccaactttgtgattggttggttagtgtcccccatcgatggggctggtcactcagtttttggcctctgctgcatccctaacactatatcaagtgtggcggggaaattgagaggcccctcctcaagccctggtcatgatggaggtacaagggaggcatccacaaggaaccatgagttgagtggtcttggaactgctcactaagtcagtccttccttttttttttttttttttttggtatttttggtagagacggggtttcaccatgtgggccaggatggtctcgatctcttgccctcatgcctcggcctcccaaagtgctgggattacaggcatgagccactggcgcccagtcagtccttccttagtttggaagttggtagtggagtcacaaagcccatgtaccttaccattcaggtaaggttcctggtctgtggacttataccgtgttcctggtctgtggacttatacccgtggtttacaggttcagtggttccccagcccatgacagatgagaaggagctatattgaaaggcaaagaggaactgttgtttgaattttcctgagagcctggcttagggctgggccttctcttaaacctcataacaatgaggttggtacttttagtccctgttttacaggggtcagaatagactgtaaagggataactgagaaaggacagagaagtgacagccagaggggctataaaaacataaaagcaagcatagatctgctactactttgtaacaagatggttcctatcacaaccctggttcaaaaagagaataatatggttttaatgttaaaagaaagcaggaaggtgggtaaataaaaatcttggtgcctgaaaaaaaaaaaaaaaaaaaaagatgatactcaagcacagtggctcatgcctataatcctgacactttgggaggcccaggcgggtggattgcttgagctcaggagttcgagaccagcctggcaaaatggtgaaaccccatctctaccaaaaatacagaaaaatttgcctggcatcgtcgttgcacctgtagtttgagctactctagaggctgaggtggaagaatcacttaaacccgggaggtggaggttgcagtgagtggagatggtgccactgcactccagcctgggtgacagagtgagaccctgtctcaaaaaaaaaaaaaaaaaaaaaaaaaaaagatacttatgaaggaaattcttataaaattgtggaaaaaatcattaatataactatttatgccatgattcccaaattgtgtaaatgataatatgtgcagagaataaaataccaaaaggaaatacaccaaaatgttaacattctttttttctgagtgactgcattatggatatttaacttttttctccttcatagttttctacattttccagtttttttaatagtgagcacttattactctcaaaatcaataacaatcaacaacagaattcatttgaatctgaagatatgtctctgccaaccacatccctgacctgccttcatggtatctcaagatgatgagaggaaggaaggctcaagttgtaaacctacattaaatgcaaggcaccatccccaaacaatgaagctaaatgttgaaatcctgcttcaaaggccctctgatgctaaaataagcccagaaaagcatttgctgcagttcttggagatctactgaaggacgtcattcacagtgggcaccaagtcaaaccctcactcgtcatcagtgttggctgcaatacaaagaatttgaaccatttgggggaggaatagggttagaccttcacaaataactctatcccttaggttgctatcattgtaataaaggggattactgacaggtgcacagcacagagctttcccaggcatcatctcatgtgaacttggcaacaactctggaggaaagacgttgatagtaacaacaacaataacaacaatgatggagacttaacatttactgaatacttattatgtgtcaggaatcaattctaaacacttcacatacattgtgcctcttaattaaaaagcaaacacaaaacaaaacaaaaacagggacttgctctgtcacccaagcttaattgcagtgacataatcatagctcactgcagcctcaaactcctaggcttaagtgatcctcctgcctcaaactcccgagtagctgggactacaggtgcacattaccttttaaaatttttttgtagagttggggtcttgctatgttgcccaggctggtcttcaactcctggtctcaagcaatcttcccctcagcctcccaaagtgttgggatttcaggcttgaaccactgtgcattccccttttaatctttttagccttatctgtgaagtagaaagagtgattacccccactttgcaagccagtatgttgtcactcaaagtagtcaaatgacttgtccgagatcgccacgctaacaaacgaaagcatagaacttgtagtcatttgtttagacctcaggtccagatttccacaactgcctactatagttcctcaactttgagtattttttattgctgtcgttattagaggagacagtagtttagcagtaaagaatgccgggttcaaatctggtctttctagctgtataatcttggacaagtcactttagctctgtgtctcaatttcctcctctgtaaaatggggatcataaaatttatctcataggcctcaaagtcaaatgaatataaagcattgagccaaagtctgccccataatgaacactcaaaagaccttggtacatgtctgattttcctataccttgccttctcacatagtcagtcaaggtcaggagggtacaatgtccttgtgttcaatgcccagaacttctagattttcagaagagtcatactctctgatttccatggcctcagcccttttgaagagcctcctttgctggagtgtgtgcctgtcagagggtagcttctaggactgagagagtacttggcaggaatgagtacttgactccttctgagaaatccttaggcctttaggactatgatgccctttgttgaactatttgaggtaggcatgttgatttcttgctggcttctgggggctcgataataaggaaatccacttctagaagagcaactgtttccctgaaaagaccacaaaaatggcaactatcacagctggaaggggacttggcatcagtcccttcaaacatgtccttgtacagataattaaccaagaaccacagaagtaaagcatcttgataagatcccacactgtcaagagccagggtcatattcaaaccctctgactcccaggccaccatcagacccaaatcagtcagtacaaaggaggcagctaagggccagtgagaggcctagaggctactggctggacaccgatggaccttcccaccttctgactctggttcaaggctctctttatgtccccaggctccctctccaggaatttccctcctagaatcacagaaatggcaccctgctgccagcttcttatcaatggccatggcaagattttaaataatgacaatactgaggcgggcggatcatctgaggtcaggagttcaagaccagcctggccaacatggtgaaaccccatctctacaaaaattagccaggcatgatggcaggtgcctgtaatcccagctactcaggaggctgaggcagaagaatcatttgaacccaggaggcggaggttgcagtgagccgagatcatgccattgcactccagcctggatgacagagcgagactccgtctctaataataataataataataataataataataataataataaaatgataataatcaggatctgctctcaggcagcagttgggaccttaggaattacaaaatcttccaaattaggtcacatttgtgtaaaggaattagaaacatctttcccatttcatcaggcccagattagaacagcctctgcagagggtcctagtagatcagtcctcctgtcaggcccatgggtgtgatttcctttctcaaacagccactgaacttttcttatgattatggagtgtttattgggtgtgtgcaatgtgtcaggtgcagtctggaatttggaactgtcacatactggcagcatgacctctttaagaggcaggaacttgttatctctgtcatccggtcccatgttggggaactatctatgaatcagccaagatgggttcccagccctccatccatctcccttcaaggcaaaatggtctaatgggaaaagtccatgatctagcatacctggctgctctacttccagcctatgttacttagagcaagaatcacctattttaaccttcagttttgtcagctgtaaaataagcatacaatacctggtctacctattgtgttgctaggaggaatcattcattcattcattcagcagaaatgtgttaaacactgatatagagataccctagtgtacaagacaacaaaaaaggtgcatacaatatagtaagataatcaattaacaaataaatgggtaaataatcaagatatttacagattaagcaagtgctacgagggagataaaaatggtgctgtgacacagaataatatccccttagagtgatgaaggaaagccttgctgagatgtgacattcaacctgaaagcaaaaggagtcaactctaccaacactggaaggaacagcaagtgcaagactttgaagttggaaagaaacagaaaggaaaccagaatgggtgaagcatattaagtgaaggagagagtggtacaagctagagggcaggactctgtagccagggaagaagactgggcttcattctaggagcaaagagaagtcagggagcgttttaagcagggagatgagggcagattatagagcagcagggacagaagcacagatagcagccagaaggctgagttgtccaggcgtgagaagatggtggcctggactggcttagaggcagattcagaatctgttttagaagtggaattgtcaagacttgctgttggattggtgtggggtgaaggaaagacagaaataaaaagttactcctagattttggaatccacaggatcactcactcactcatgcattcaacaaacatcaattaagcacatatacctgcctgtctctaggcatggtgttggggataaagatggagatgaagatcacagctttgtcagggaaatggaccagaaaataggcaaatataatgcatttaagtaagtgcagtaaatattaaagaacatcgaactctgctgaggggaaagaatcaaagaaaagtcttcctaggggaggggagtttgagctaagccttgaaggagcaacaggaatagcagaagggctctggggttatagaacagagctctgaaataataacaatcgtagtagtagtagtagtagtaatagcagctgatatttgttaaggcctcacaatgtgctaggtactgttgtaagcataaatgaatcatttaattctcacataagaatcctataaagtagatcctattaccatcatccccactttacagacgaagaagcagaggcacagttaacctcagttacataacttgccccagatcacactcataatgacagagccaggctttaatcgcatgcattttggcgctggaaactatgctccaaacaccgcaagaaactgcctcactgtgggacgtcaccgcacatttaggggcggacaacaggtgcaggaggtataaggtgtaggaaggtaggaactgatgggaggtcacgtaaatgacatgaaagtattttgcaaactataaagtgctgtccccaagcagattatcatcactactattataataaataactgcctttcctccctgtgaaaaatgaaggcttctcagcagtatctctgggttattggccttggaaaaaagtggctgcttggagggcctgcccagacagagggaatctcgggaaaggatgggctgacgtgaatctgaccctgagttgggaagcagcagatgtgggctctggtcccagctctgcacctaacttattatgtggtcttgggtgggttacctccccaccctgtctttagtttccccattgctaagatagaaggaggaaagagtggggatttttttttttccagacggagtctcactctgtcacccaggctggagtgcggtggtgcgatcacggcccactgcaacctctgcctcccgggttcaagcaaatctcctgcctcagcctcctgagtagctgggactacaggcacatgctaccatgaccagctaatttttgtattgtttttagtagagatggggttttgccatgttggccaggctggtcttgaactcctgacctcatgtgatctgactgccttggcctctcaaagtgctgtgattacaggtggctcacacctgtaagataatcaattaacaaataaaagagtggggattctaaggcctttttcagccttcacattttgaacaatcgctgctactgttggtgttccacttctccgagctggacagtgaccgaaaaagaatgtcaccttggggccctttaccaaaacaaaggcttgctggcaacctcggatggcagtggcaccttccagaaagcaggacccatgctggatgggaagcccatggcttatgtcccctgagtccacagatctccagttcagacgcttctcatcactcctgtccctgccaggacactcactggtttcaagctccttgaaccaggcccattcctgtcccttttaatgttccagtgggagtctgagtaatgacagcattctggataccatcctttccaggatgtggccagaagacgcagatggagtttacatcctaaggggtcccgttttgatttttctgtgagccaaaaaccccagggctttctcacatgcgctgctccaggctccatcttttgccattgagggttttgtattcactgtcctggaattaaaagtgttctcaagggatgcagcattgagtctttctcctcatgtctcaggatcttcatcatgagaatacaatcataagcctgcaagagatccccttacatcaaagtcattcaatccaaacccttctcgctgacacagaactccgtaaactgtaaagcactgttgtacattattaattcacatattattccttctgtaccttataaaagtcctagtttgggcagggctaggattaccagataaaatgcaagatgtccagttaaatttaaaattcaaatttaactaggcatcttgtgatttgatccattaaatctagcagcccttgatgggatcaacagtcccattttgcagaactgaagctcaaagggatgaaaggattttacccaaactgcttgagagcagggactatgtctgactttttaaaaatatttttttcaaacatgagaagtatattcccttaaagccagtgtatcagtccatttagcagtgatctaaaagatttatgctttgtgaaaagcctattcatctatgaatagagaatctatgccctgtgtctgtgtaggtgtatatgttgcacagaacattaaaaagttaataaattcatttttaatccccagttcccaagttggggttagctcagagaagatgcttgagaaatgtttactcaactattgggctttctgaatctttcattcctacaagaaccctacagaatgaaaaagaaattgctggctcaggacaaagaatggccccagaatgcagtgtcaggcttccctgatcttcctacatggctgtgccaaagatgagttgagtttcaggaaagtgcagtgaaactatcagcagtgaaactatcacatcatgaaatagtcatgggcctcacgaaaaggcttcttgtcattacacttccttcctgctccaggtttaagaccacagggaggcttccctaaggctgccaaatacagcgaggtcttggcataaatgttgcccaaggagtccttacaccatcaaaggcagaggcacaaagtccctttcctgccctttggatgagtagacctgttgggggcgctggtgggacagcccccaggtggcttctagacttagctcatctccctcctgatggacagctcaggatctgtccactgacagatcacatacttttttcagctgcccagccagagctgtgaataaacacagactctccgagaagacttgagctgccgatgacagaggtcaggggtcttggttccattccaggctgtcagctaagaaagaggatctgctgaagaattggagcctgggcatgagctcttgccatggatggaacttttttcatgtgtgaggttcaccagttaatcctagaacgttagagttagaagagatggccttaaaaagcacctaggtcaggccacgcatggtggctcacgcctgtaatcccagcacattgggaggccaaggcgggcagatcacctgaggtcaggagttcgagaccagcctgaccaacatggagaaaccccatctctactaaaaatacaaaattagctgggcgtggtggcacatgcctgtaatcccagctacttggaaggctgaggcagcagaatcgcttgaacccaggaggcagaggttgcagtgagccaagatcgtgccattgcactccagcctgggcaacaagagcgaaactccatctaaaaaaaaaaaaaaaaaaagcatctaggtctaatccaaacattcttccaggaagacacaccaaggctcagagcaggaaaggactcattcaagctcacatgataacttggcagcagaaccaggcctggaatgcatatttcttcttggtgctgcattcctgattcagaagagcagctctccctgctaagcaaacagcaggtgggcggatgtggtcactaatcagtgcactggcactgtgggtcattgagctttaaccccagagcaccattaacagcttaacccagtctgtcaccctctcctccctggaggccctgcagtcctcaggattagaaataaactgctctcagccaagcccctgaaataggagatgaaatggcccacagagaccatccaatttagttcccccagtgatgccgaatccccaccctctgtgctgggaagcagttccagtgaccaatgagctcagtgagcttgcaggtgtgtgggcaggctgcacagaagcagagggtggcgagtggaccacagggggatggatgggcatggaactggtgcagttaagcatcggcgttcccattctgtctcctgtcagctctgttctcaagtccttttgctattacactaaagcccatctctgtgaacttctgtctactgggtccagctcagatccctggagcccaggccacaccccttgtgaagctgctaaattaggcgggaaccctggtctgcatgcaggactggctgcctggctctgttccctgccaagccaatatctgtataccacttaggagaaaaactctaaagccaaatgaggaaaagcaaggacggctctgcctgtgatccttggatggatcccctgtatgtgccagcactattctcagctcttagcagagaacagaaaggctctgttgctgttctcatggagtttatgttctggttagggagccagagagtatatgggtacctaaataaatcagataatttcagaaaatgacagtgctaagaagaaaacacagactaataatgggatagaaaatgactccggggtggcatgtcactttcacaagcatggtcaaggaagccatctgggagaaggtacacattgagctgaggcctgaatgagaacgaggaggcaggctggggaagaccagggagacagaatggtaaatgcaaagtctcatagacagacacaagcttcgtatgtgtttgagagggagaaaaaagctggaatgggtagaatatagcaaatgagagagagaaaatctgaaaggaagttttggtctgagccacagtctagtgcgctgagctgggctaaaggttaaatcatggtgatgattccgcttcc

SEQ ID NO: 82 - DNA, 133522 bp, Homo sapiens
agaacatttaacgaaacttcttggatttaccagtggaaaaactgagatccagatggattcagcggcctgcccaagttcactctacaagtgcataacagagcaagaatagacccaaaatgggcagacttccaggcctgtgctctcctcgcttcacaataccagtttcccacccatttcccataggcaaatatggcgtttcttcatggatccctgtggaaccatagaatgccaacaacatgtcactttgcttctttcagcctcctgtggatgccgtcctggccacagaccactcactgaaaacacagaaacagcagcaattcaacttagggaggtgtctcatttcatttaagtatacccaaaacccaagagtagccttactcaaatactgggctgtagattggttttctagtcaggaagcaaactagctggtacctgatccaattatccactcactagagatagaaaaacattgcattttttgtaaagtttttatttaaaacctctttttttttttttagacggagtttctctcttgtcactcaggctggagtgcaatggcacgatctcggctcactgcaacctctgcctcccgggttcaagcgattctcctgcctcagcctcccgggtagctgggattacaggcgcattatcagcacacccggctcatttttgtattttcagtagagacagggtttcaccatcttggccaggctggtcttgaactcctgaccttgtgatccacctgcctcggcctcccaaaatgctgggattacaggcatgagccaccgcacccagcctaaagacctcttaaataatagggagagaggaagcgaactattcattatagaccttgcatgtgctgcgatgctccacataaggttttcacttaaccttgctgcaaccctaagaggtcagcatcaagaccagcctgagcgacatggcgaaaccccatgtttagtgataactaaaaagttattacttttataggtaatggcgacaagacgaagagccatctgttaagttgccccagatcctacagttgtgaggcctgcactagaacccatatctctctgcttttgaaatgggagggttccccaatccctctcacaggacgtgtgaaggcaagtgtggcttgcctgtcactgccactgctcaaacccccgagggaagggggaacacacagacaggcagttgcaggaacccaagtgggcatgtgttacagtgtgcccttttagccctcctatctgtagacggcttgagtgttaaaccgctcaatggaccctctgccttttcataagggcagagggccagtgtgatagctttctgtattgtgagctcttgcctagcatcctggaagaatcgggtcacacatgggcttgaaggatgaatgtggggttttattgagtggtggaggtggtttttagagggatggatggggagctggaagggggaatggaataggaagatgatattcccctggagcctgcccatccagtggccgaactcctctctgaccacccccagccaaactcctctgggcattcagatgttcctcttcgtctctctttctctgttgcatcattccgcagttcctctgcctatctcatctcctcccctgcttgtctgcttccggagcctggagttcggggtttatatgggtacaagatagggggtgtggtgggcaaaaaggcaactttttgggcacgaaaacagaaatgcctgttcccacttagggctgcaggtctccaggcttgagggtggggcctttgccggggaccgctctcttctactcagtatttccctgtctcctgtccatatcactttcaaagctgatgctttttgtaccataagctattatcttttagaaccaagaaaaatagattttatgttgatgttccagtatgcaccttttaattagacagtaatacaggtaaataatctatgttgctgtttgttgggcagctcatagctcaactgggtgccatttgctaacttagcctttagcctaggttttctggtatgtttctgcttcctccttagtatacttaactgatactttaactcttaattcaaaggtttaatgatctctaccttttaatacaaaaagttgagatacagattgtaactaaataaaattctttacccaggacagtacctgttaacattgaaaccttttcattttaactgaaggaaattcaaaatgtaactgttgccaaattccttgtttccaaatttaaaggcctctccatttcagacaattccactggggattaatggcccattggcgtctatacaatttccttaatttaccctaaaattattatcttgagtaaagcagaatcttaatagacaacattaatgtctttatccttgtctggaaggatctcatctctttgcaaaaaatagcttcttcaaacgaggctggataatcccccctagccatggtgattaaagataacaatggctcatttagaaaatgttttggggaaattaaaaagctgagatgaagcctgttggttctggagtaaaagtaaaggcaggaaggggaggacaccaaaagcatccatatattggactatgtttgcttcctactcagtcagcacaggccgcagtgtttgaggacatgcagtcaggtctgtgggcgtgatctctctctacaccgaaggaatgagcttcatcagcaccattccatcgaagggaattttgtgctgtatgttcccagggtcactcacaaacatccctacttacaagtgacttgatgctttccaaaataacagtttattgggattttggtttaagtttgcactaattcaaagcctgcagactgcagtatacttacacacctttattgtacttatgagtgtagaaactgtgatacggctgattcacttattcatttactaacatatagtgaggggtgtgtgtgtgtgtctgtgtgtgtatgtgtgtgtgagagagagagagacagggcctcactctgttgcccaggctggaatgcagtgacaagataatgacttactgcagcctggaccttctggccttagctgggcacagtggctcatgcctataatcccagcagtttgggaggccaaggcaggaggattgcttgagctcaggagttcaagaccagccctagcagcatagcaagactctgtctctaaaaaaaaataaaaattatttgggtgtactggtgtccacttatagtccatccacttgtaatcccagctactcaggaagctgaggcgggaggaacacttgtgcctgggaggtcaaggctgcagtgagccaaggtcacaccattgcactcctgcctgggcaacagagtgagaacctctctataaacaaacaaaagaaaaaacctcctgggctaaacgtttcaatcttccaaacatacagttgattcctctggcaaccagcaccctcatcttgaggggcttttccaaagtcacttcaataactcaggtgtggtcaacagggacttatgataagtaacaaaagttgttcctttcacctttatcaccctggacctattacaagagccaggggcaaaaaccaaatataacttaagatgctactacagctcttatcatttagaaacttgcacaaaagctgggagctagacaaagacccaaatatatatttcttttttttttttttttgagacagggtttcgctctgttgcccaggctagagtgcagtggcgcaatctcagctcactgcagcctccatctcctgggttcaaatgattctcctgcctcagcctcccaagtagctgggatcacaggcattcaccaccatgccaggccattttttttgtatttttagtggagacagggtttcgccatgttgggccatgctggtctcaaactcctgaccgcaagtgatccacccacctcggcctcccaaagtgctgggattacaggcgtgagccactgtgcccagcctatatttcttattatatcacaatacacaagagagtatcatcatcatcatcatttttatcatgaatgaatattggattttgccaaatgccttttgtacagctattgaagtaatcatcatattatttttctttctcagcctttgtgaattacactgattgatttttaaatgttataccaaacttacatttatgtgataaaccccagttggtaatgaagtactatttgtgcgtgtgtgtgtgtgtgtgagtcagagtcttgctctgtcacccaggctggagtgcagtggtgcaacctccaccccctgggttcaagcaattctcctgcctcagcctcccacatagctgggattacaggcatgcgccaccacgcctggctaatttttgtattttttgtagtagagacggggttttgccatgttggccaggctggtctcgaagtcctgacctcgggtgatccgcccgccttggcctcccaaagtgctaagattacaggcagaagccaccacgcccagccttgaagtactgttttttaaagtgtattgttgtacttaaatttgcttgaattttcttagaaatgtttctctctatattcatgagagacattggtctgttgttttcttgttatgtcttctttttttatttgggtaatgctggtttcatagaatgagttgacaaatattgcttctttagtttttctggaagggtttgtgtagaattggtaatatttctttaaatatttctagagttcaccagtgaagctatctggacctggagttttctttgtgaaaggtttgttttttgtttattcggagacagggtctcactgtgttgcccaggatagagtgcagtggtgcagcctcggctcactgcagcctcaaaatgctgggctcaagtgatcctcccacctcaacttcccaaatagctgggactacaggcatataccagcacacatggctaatttttctttttttctttctttctttttttttttgtacagacggggtctcactttgttgcccaggctggcctcaaactcctgggctcaagcagtcctcttgccttggcctctcagtgtgctggtattacagtgtgagccactacacatagcctgtgaaaggtttttaactacaggccaggtacggtgtggctcatgactgtaatcccaacactttggtaggccaaggcgggcagattacgaggtcaggagttcgagactagcctggcaagcgtggtgaaaccccgtctctactacaaaaaatacaaaaattagccaggcactgtggcgcgcacctgtaatcctactacttgggaggctgaggcaggagaattgcttgaacccaggaggcagaggttgcagggagctgagatcgcaccattgcactccagcctgggcgacagagcaagactccatctcaaaaataaataaataaacaaacaaatagtttttaactacaaattaaattaaataaaggtaacatgactacttaggttatctatttctttttgagtgagcatggtttgtgtctttgaaggaatatgtacatttcacgtaagtcatcaaatttgttggcataaacttcctttattatccttttttttagacggggtcttgctctgttctgtcacccagactggagtgaagtggagcaatctcggctcactgcaacctcggccacccaggttcaagcgaattctcattcctcagcctctcgtttagctggaactacaggtgctatgcctagctaatttttgtatttttttaggagagtcggagtttcaccatgttggccaggctggtctctcaaactgctgacctcaagtgatccccccacctcggtcacccaacgtgctgggattacaggcatgagccaccatgcctggcccctttattatccttttaatgtttatgggatgtatagtgatttcccctctctcattcctggtactgtttttgtgtgtgtgtgtgtgtgtgtgtgtgtgttttcttaatttttctgattatctatctgtctggaagtctataaattttattgaatttctcaaagatctagcttttagctctgtttttcattttatgttttctattttatttttgctcttgtctttgttatttcctaactgcatactttgggtttattttgctcttcgttttctagctttttaagatagaagcttacgtcattaatttgaagtcttttttgtaatatagacattctgagcttttctctaaatactgctttagctgcattccacaattttgaaatgttgtttcattttcattcagttcaaagtgctaatttttcttttttttttgagacagagtctcactctgtcacccaggctggagtgcagtggcatgatctcggctcactgcaacctctgccttccaggttcaagcgattctcctgcctcagcctcccgagtagccgggattgcaggtgcctgccaccacgcctggctaattttggtatttttagtagagatggggtttcaccatgttggccaggctggtctcgaactccttacctcaagtgatctgcccacctcggcctcccaaagtgctgggattacatacttggcctctatgacttacttttttttgctcaacattgtttttgtgattcatccacattgatgtatatagctgtaattcattcattttccacggctgcataaaattctgttcaaagtatatggatagaccacagttcttctactgacagacatttggactgtttccaattattttgctataataaataatgctgcagtgaagaatttgaaatgcagcttctggtgcacatatatgagtttctctaaactatataccaggagtgaaattacatgcacatcttcaaaacaaaccatttttcttcatttaactttgattcagtttttaataattctccctaatccctcttagtgactgtatgttatctcatgaagtatatgcactaaactacatctctattcttttttttttttttttttgagaaggcgtctcactctgtctcccaggctggagtgcaatggcatgatctcggctcactgcaacctccacctcccaggttcaagccattctgcctcagcctcccaagtagctgggattacaagcatgcgccaccagacctggctaatttttgtatttttagtagagacggggtttcgccatgttggtcaggctagtctcgaactcctgacctcaagtgatccacctgcctcagcctcccaaagtactgggattacaggtgtgagccaccgtgccaggctacatctctgttcttgaacatctagaatttattcccaagttttgaaactttatacaccagtctgaaaaaaaattttgtggagcctctgctttttaggtcatttccttatgaagatttcctagaagtggacttcctgaaataaagaccaatttaccaattgtgccaatttgcattcagtgggaggattttgattgctgaaaaatgaagtaataatccttcaattagttgtttatcctttggggatcatgtatcttttttttttttttttttttttttttggagacagagtcttgctctgtcacccaggctggagtgcactggcacaaactcggctcactgcaaactccgcctcccaggttcaagcaattttcctgcctcagccccctgagtaagtgagatcacaggcacccgccaccatgcctggcttaattttgtattttagtagagatggggtttcaccatgttggccaggctggtctcgaactcctgacctcaggtgatccacccatctcggtctcccaaaatgctgggattacaggcatgagccactgtgccgggccgatcatggatccttttgagacaatgattaaagtatgggtcttctctccagaaaaaaagaaacacaattgcatcaataaacaaaacggcatgaaatttcaagggtttctcagaacctctgaagcctatgtaaaattgacacctctcttgaataagaaatattatcgtatccactgaatagaagttttgttgccatacttcaacaaataagttcacataccaactcttgtattgtcaactaccttttgtacataaaccatcacttactgagcacccacaatgtaccagcaacatgccagatgccagaggcagaagaataaacgctcctaatttcaaggaatacagagttcactggggaaggcacaaactaacaagtatttataataaaatatatgcagtagtagaagtattcattaggcaaaatggaggtacaaatttaagaattgatcaactttcctttatcaaaggtttgcaaagaatgaatgagcattctcaaggatattataggtaggggaaacagtaccagcaaaggaggaagacatcatataacctggcatatgtaggaaattgtatgagtttaacatggttgaattggaatagtaattaacgtggcaagagctgagacttttccttctttgggtcaaagattgaaagaaccaatactgacatatacaatttcagcagtttgtctaacaacacaaaggaaaccacaaaagaagatttcctcccaaatacttcttttattacccaaacctactcttattacatacaaagaaaacattttgcctgttttcttttgcaactgtttgaagtgcagtgttccattcaacagacaaggtttaaaatctacttattattaatacaaacaagcagcacattgtaaatttaacattgtctgatggctttcattttgtacacggaagtactagaaagcctgtacaattactacaataattcctcataaaattgccttgaaagactaacttataggtaaaactgcaattttaacattgatttagatagaatgttgattttcagcctgtcaacactcctaatgctatcatctcatgaaaaacgtttttaattcagcttaacttttttttttttttttgagacgaagtctcgctctgtggccgaggcgggagtgcagtggcgcaatctcggctcactgcaagctctgcctcccgggttcacgccattctcctgcctcagcctcccgagtagctgggactacaggcgcccaccaccacgcccggctaatttttttgtatttttagtagagacggggtttcaccgtgttagccaggatggtctcgatctcctgacctcgtgatccacccgcatcggcctcccaaagtgctgggattacaagcgtgagccaccgcgcccggccaattcagcttaacttttaaaatataagtaagcacactgttactttgaagttactgacttaattataatggagcatgtggaatttttttaaaacatagatgttttatactcctatggaaaatgaatacaaccagttttgataatgcaacctcgcaaatgtccttacttgtttgtatatatatactttctcttgaaactgtaatttgtttagatttctgccatgcttattcttttcccttaatacccaattcatatacatcacagaaccacatgtataaacataaggtgttattataaagtgataaaacctgttttcttgtgtggctagaaaagaaaaaatagagtttaaaaatttaaatgttaaccaactgaagttgaataaaacagtttaagtttataaagctctcagcacaaagaaatgcctgactttttcttttttttcaaataaaggaatctctcagatggcatcccattaaacaccatctagctttgtcaaaatacaggttcttcaagagtagcttaaaatattaaaaagatgtactctcattacaagttacttaataaacaggtagaatatggtttctcttcagatttctaccaaagaaaggaaattctttatatgtgtgacaaagaaatccaaagcgagcaagttttctctataaaatccgacggatgtcagagggaataggcaaaagcacaaacaaaaatatatgttaatatattttcttctcaggttttgttttcctctaagagagggaatcttcttcatggatttttttccccccaagtagaaaacattctttaaatgaacttaaacaaaatacatggccaataaatgaagagttcaaagatttttatgaagtgggctgaaagtaaatgatccttggcatgtatttgaagacatgaaacaactctgaccacacaaaaaagtaaacaacaaatctacaataggtacaaattatatacatttatttttaataattttaaataacactcttgtataaattctttcatatattcaaatcatacacaaatttagaaatgcatgatgaagcctagtacagcatatgtatgagacacattttttaagtttgtgttagaattttagtgacataaatacaagtttaatgtttcagaaacattccctaattgctcggcctataatttaatgtattatagagtgcttatgcctagcattacaacttgactttaaatcatttagcttttggactaacttagatctgaagccctgggcttactttctagggctgctgctgcagtaacaagtaacaattcctacccacatagcccaaaatataggaaccagggatgttcattataagtggtgttatgttcaccaagcatcctaaaaagtgtaggaccaaggtgaatgatctaataaccccattccaatcaaagctgtcaagaggaagtattgttgctttagttttctactcccaaaacagcacttaaagggttaaatatcctgatggtactcagctgaccaaaataaactagtaggtcagtgagtattgctttaatggtcaatttacctgggaatattggcgctagagaacagtgatataatttgaggtgtctacaaatgttgtctaaaaaacctctctcctctcatcccatgtttcctctgttctctactcttaaaatctaggtatcactgggaagagtaacgcactaggcccacaggaccttagtattaatataaatgagctttagttttcaaatgtcatttttttctctataactggagaaattccattaataaaagaaccctaggggatagagggtagagggagcgagaggggagtaagggaggacacggacatacttaacactacctagggcacctaaccatcagaaatgcataggcgcttaccaaaatgaattaatgaagataaaagcatcgcttaatggcagtatctgtaatttccaaataagattcacatcagtgctatcttatttaaaaataaacagatttccaatccttacacaaacattctcccaatattaggctttctttttcttccttttttttgagacagagtcttgctctgtcgcccaggctggagtgaaatggcgccatctcggctcactgtaacctctgcctcccaggttcaagtgattctcctgcctcagcctcccaagtagctgagactacaggcacgtacacccggctaatttttgtgtttttagtagagacgggatttcgccatgttgaccaggctggtctcgaactcctgaccttgtgatccacccgcctcggcctcccaaagtgctgggattacaggcgtgagccaccgcacccggcccaaaattaggctttctaaaggactgatggcatcctgctgccagatgccacagtttatggggcccatgcctttagaggaaagaacattgtgcagtgcatcccatgctagtttcctagaatgatttcagtggtagatcactttctgattgatttatattttaaagcaaattatttccagaatcaaaaagctcgagacattagaggatcttatttaaaacaaattttaagactttttttcccattgagaaaaattataaccatgatctaggagccattaacaagtatttaaaggtaaactttctttgtgattcaatttttcaataccttttaaggtctgtttcaaggaatttctacatggtcaaaatcctcttagactccaacaaacctcctttctctctattggtttaacttctgtttaataaatgttcacttctcaccacctttaatcctgaccttttttggggggggcagggggcggtgtatctgggagaaagacaggtatgccattttgcacaatttcttagaattgtgcagtctgtacacacatatgcagcaactgctagggaaagcaaattttcccttcctgcttggagagatgagttcaccttaatgaagcacaaactggcagttttgttttctaatcactaatactaacttcagttagtaaatcttcttgtgttcttttcactaagtgcttcatagctgtatggccctggattgctcctgatatttaaaaaaaattaaaaacatccacaagtagaactcttcctcccagctttcttgtgtccatggctaggcaatttctgcatatagttgaaaaaacatgtgctttagagttagaggccctgattccaagcctaataatcacacacattgtatagccttgaacaagatatttagctcctctgtgcctcagccttttcatctataaaatggggacaacaattacttcctcagggggctatggtgtggaagagaggacacacatatggaaaagtgctttgcaaactacaaagggctatagaaaaactaaataattttcatataatgtaatataatgtaacctctattcttctgagcaatggccaaatacgcaaagcaccctcagattaccagaagtagattatttgcttgtactccctccagaacatcatctccaaaccctgagaacaacttaggggtctcctataaagggatgaccaagttctaggtttttctctagggaagttaggcaaaggggtcagcttgaatttcctaggtctaatctaataagaagtttttattttttttctaaccacttcacagttcactgttcctcctaataagttatatttaacatctgaccacctttcccacccaccttgcttaacccaaaatgtcaatatcataataaacgagagcaacagtagttggcctctaggaaaaaactccatcaaaaagcaagaactaactagacacacccatctacaaagctgctcattaaccagacaggaagacaatgggagaactatagcactgcagggagatggcacatacctcatggcaaatgagtgacaggctatgttcacatgtaggagattttttatttggggtgagggaggattataaatatttcataggcatgaaaactacagatcccaagtaatatgatggcttttctcttggaactaaaatatttctatcctttggaagactatcttttacattcaagaaaaacattttttaatgaggatatgttttatattaatctatgtaaaatatatagggtggctaatgtctaattagattaatgtttttggagaatgcatcctatgtcccagcttaacgattactgacttcaaaatctattgcttgaatcatagtaagtcaaagagcatataactctacttttagactgagaaaggaaagaaagaaacattcgacctcttataaatttcagcaatgtcctcaagaaggactaaaaatgacggatgctcaccagagtcccagctctagcaatattgccatctattttacagtattttaagcaatccccatatttttctttttacaacaccattaactgctgtacaaataaattccagatgataaaatatgacatgattttttttttacaaatagatacaaatacaacgtcgaccagatatgctacattaactatgtacaccttatttctctagaggcaggaatattccttatttttagacaatttatcatttacactgagaccctgaggaggaccatcagcctcctgctccccaatgctgccttcctcccttagaagcttatcctgtgctttcaactcatcactgagcaagaatcctgggaggaaaaaaccaagcccttctgaagatcttgggacttttctacccctgttctagaaacaatcaagattatttactgtgatacagcctagaaacaagcttttcctcaatgatgtccttttgtatagtaaaacgaatataatccctgacactgttttaaaaaaaatgtttcaggaatggagatgaagtcttccagcagtcttttccccctccacattcatcatcttgttaccactggcttggtgaatgcttccccaggagtctatctggaggtcaaagtggttttgggctgcactatggggttcagcctttccatactcccatgtggtttggtacaaaaatatactttacttcaagtcctaatgacagtgaacgcttcagatcttcatgggaaaactaagagcaatagataggctaagcgcattacaaatttgtacctgaaaatttcagatgcactatttgcctttgctttctcagcaaactctagccaggctttgtctggcccaggggctgactctgtcttagcaagcactgtggtttaacaattcagaacagttctagctccttaggctttgtagttatgtatgggcgtcgtcagggtcagctgcccattgggagccacttcattgccatcatcttccaacaatcccgaaacatctgcattgggaatgctgtcatggtagctgctgaaactgatattgtcttctttcagctcgatggtccaaaagggggcattgagtttccggttttggtactcgcggtacatatatacagcccccacaaatcccattagcagcaccacaacaatgatgatgactgtcaaaatgatgatgttaaattgggtccatgatacatcagctaaagctgaagtgctgttttcagaagtgcttactgaaaagatagtctgcagggttgtaggggtaaaagtactatttataacaggggtgggcactgatgtggtcaaagaggcattggaaaccaaaatggtagaaccttcaggtgttggaagaataacttctgaaaataaaaacagagaatgaaatgtaaaagacaaaattatctagttttgagaaacaataaaagaaatacgcatgggagtgaatgttgatgtaggatgttaacatgatattctgctttaaggtaatgcaagttaaaaataatgtttaaagaaatatagtgataagggtaagaatcagggtctagaaagctagattattacatctatggctgttttccaatatgtataatatctacattaaaatctttgggccgggcgtggtggctcacacctgtaatcccagcactttgggcggccgagggtggtggatcacgaggtcaggagttcaagaccagcctggccaagatggtgaaacctgtctctactgaaaatacaaaaaattagctgggcgtggtggcgggtgcctgtaatcccagctactcgagaggctgaggcagagaactgtttgaagctgggaggcagaggttgcagtgagctgagatcatgccactgcactccagcctcggtgacagagcgagactctgtctcaaaaaaaaaaaaaaaaaaaatctttgggaaaataccagtgttggagttttccattcttatttactcttagataaaatcatataaattcctgcaaaggcagtaaatttgtcactactgagctctaaatcacatagttaaaagtaacagggatatatggcaatcatttgaacaaaaataagtctaacaagtctgatggcatttcataaaggtaaaataattatctgcaaaggaggtgtagggaaaactatacctctagttatgtctgaaaaacaaattttaaatgtctgaggctgacatcagccaagagagaaaacagctttccttaattccatgtgtaggaattcttcctttgtgtagattacagctactttataatttaggtattatactttgtatttctaatggcagcatagtttggtggaaggactaaaggctttggaatcaaatagaagtgtgtggctacagataagtaaatttttttaaagctcggtttccttatctgtaaaatgtgaataataacatcaactttgctgagttcttgggaaggattaaatgaaataatatactacacagcattatcacatttaatgcttacggtgcttggcatatagtaggtactcaataaaagtattactattattattataattcttcaccatgaaagccatatcaatttattctaaaaagaggcaaagtttatatatattacctattagctaataagaaaaatcatcagttctgtcagctaactatggacaaagtgtgcctcccaaataggtaagagaactgagtagcaggatctctagctagtaatagggttcaatctgaatctttttgccttgatcactacagtataaagatatcaagaaaatggcagaaagatgacagttgccatagaccaactgttcatcagcctcgtgttcagcatgttaagaatatcaaagagtggtttgtagaacagcatggtccaatctctctgtgacctaataaaccctcaatatcctaactcatcctgaattcataatcattaattttaattactgagctttcctataagaaatattttgccatgtggataacttttgcttttaaaattcaaaaggaatattattatttcctccattgtacatggggaaacttaggcccaaagttaggacagatgctagaatgaactccagcttctcagctggaacttctaaccagattagatgtccctacttcaaaagacctttgatgatccctcaaagtgatgagaataaaggaagcaaagaataaaagaaatgataggattcttaaattattaacataaaaataaaaatagatgaagagaaaaatgtgagaacattttgtctcactgtcgcaatgactttgtcttggtcctcaaatttctggagttgactgtggagtgtcagaagagcagcaggaatggaaggaaacctctttaggcaaatatctatcaaaatctatttccagaaactcctctggtagggttagaaggttttacaaagccttccatttttcactgctagttttagatattaaatttacaatcacttaggtgaagttttacctttcttgatgcaatttccctcgaggtcgtgaacataaccttctaggcagttctcacaccaaaacccagtggtgttatggaggcagttgatgcactcaccactctcgggcttacaaatctttggagttttaactgggtccacatggccgtgacattggcactttctacagatgctgtcaaaattgtaatagccattttcacatttattgcagttcgggcctatgtaaccatctttacactggtcacattcaggttccaattcactcgattctaaaagagagaatgccaaaatagtttagtacagtctgaagctacaattaaaaatgcaaaacaactactagtccttaaaaagatttataatcccagaactttggaggccaaggtggaaggatcgcttgagcccaggagtttgagaccagcctgggcaacatgatgagaccctgtttctaatttgttttttataaaccttccctactgtctcctctctagagacatataataatctctattaattaattaaactaataatctataatctatttactaattttccagcttattgtaggaatgatggggccatccagagaacctattcatgtagagagcaaaataaataggcttacataaggagtctgaatgattatgatgggttggcactctcataattgtgttattcccttctttttatagatgacagattggataaaatattgttttaacaaaaacttcctccatccctcccaaacttaaatgtgggtactctgcagacttctattcttggtttctttctcttctctgctcattttccatgggtggcctcatccactgacatcatcaacaattccaatatgtgtatgtgtatctctagtctacatctctgtcctaaattccaaactatatactaacttcctgtacacctggatccacaaacatctcaaacttaacatgtacaacactgtcctcagtatcttcccttcctgagtcctgtcttcctccaatgttccctagatctcagtgaatggtaccaacatctacccacttgcataagccaaaacactgagaatcatctctcaatcctcttcctccatatgtcccttctaagcagttatcaattcatattaattgtacctgattaaagtctttccaatccacggatgtctctttccattcccactggagtgatcttagattaagccttcatcatttctcacctagattattgtagctacttcctcatggttctttttatcacaatgcacccctacattcactttgaacttcaaagtaaataagaatatgttacttctctagagaaatctcttcaatggttccctaactccttcaggattaagtgaaaacgtaatagaatttttagtacttttcataatctgacctctgcctacttctctcaacttttctctcttcacttcacactccaccaccccctaaggttcaggcacattaaatggcttaaaagaactcccaaatacccaaatactgcctgctttcttctgtctgaggttttgtacatactactttctctgcatgggacatcctcttgtctctctttctagttcagttagcaaattcaatctgtaggaattaactcaggtattacttcttctcagaagcacagaagttttccttgattccctcagtttaggatagggttagtctatgcttaactgtaacacatgtcatttgaaattgtaattacctagttacttgtgtgtttctcccattaaactatgagctatttgacatttttctgtctttatcgccaatgtttagcacagtgcctaaaacatagcacgtgttcaatatgtatctactgagtaatttcactttaggcagtaggaacataacaactcatacctatctgtttccttttttattcttcataggatttcaattctggattcttaattatatttaataaataatttttaataatcaacaagtcatcttttaaatctgctagatagattagttctttccttagaatttactattataattacactaacaggatcaccctgttatctaaacacagactaatgttattatagcaggaatactttacagtggtcatggaacttgtggcaatgaatcatatttctgatgctctttaagaaaaacgaattcctttcatctttcacttttactttttaaaatggctttgagatataatttatataccgtaacattcaaccattaaaagtatacaattcaatggttttagtatattcccagagtgtgcaactgataaagaattctaacttaccacttacaatcctagtgggtagtgtgatctcaagtaagttactaaactctgggcctcagctttccatatttcaaataaaggaattaaaccagaaatacttaggttactttcagcaataaaaggtggcagctgaattattcataacccatgcaaacaataatatgcaggaaaaaaattcttagtgaaaaggcatatattccttgttctcaatgaagttacagcttacaacagtaccatattttacagcatttttgtacttcaacaactatagcaacaataatctaaagaattcctgatgaaatagactgaaggactgaaattaaggtttgtgaaagcctttcatgcctgtcatgggcagaccaactggacctcaaatatgacattcaatgtgctgcctgatgtttcactccttctgccttatactttgtttctgccattcttaagtagtttcttgatcaaataagctgttttaagatttctgtaccattgttcctactgatatttttatctgaaatgtccttccttctcctgtctacctgctaaatgcagactcccatcacgagactcagcttttatgtcacatcctctctgaagccattgctgatattcccccactccaggcaaagtaattattccctcttggtgcatccactatacataaatacatgatattgcactgtagtacgagagcttgagggacaggataatttcctactgggaggtatagaaaagtcttcatgaagcaggtaacatttgaattgggccttgctaagaaggtcaccatcaagaaagcaaaaaattaaaccacaaaatagaaaaaatatttataaatcatatatctgttaagggacttgtatctagaatatataaagaattatttcaactcaatgataacaagataaataatccaaattttaaatgtgcaaaggatctgaacagacatttctctaaatatatgaatgaacaataagcacataactagccatcaggaacatgcaacttaaaaccacagtggaataccacttcatatctactaggatggctataattatacaaaggcagatagtaagtgttggtgaagctgtggaaaatttggaacctacatacagggttggtgagaatgagaatgcaaaatggtgtactcattttggaaaacagtctgacagctcctcaagaggataaacatagttactacaggacccaggaattccactcctaggtatacactgaagataaatgaaaatatatgtacatacaaaaacatgtatacaaatgttcacagcagcattatttgtaatagctaaaaagtggaaacaacacaaatgtctatcaattgatgaagagagcaatgaaatggggtataacacaataatatattatttagtaacaaaaaggaatgaagtactgagacatgttataacatgaatgaactgaaaatactatgctaagtgaaaaaagccagacacacaaggccatgtattgaatgacttcatttgtatgaaatgttcagaatgggcaaatccatagagcagaaaaagtaggttagtggttgcctaaggccagaggaaaagggagtaattgctaatgattataggattgttttttaggtccttttgttgggggaggtgatgaaaacttctaaaattgattgtggtcatggttgcaaaactttgagactatgtactaaaaaaactgaattttgcatcttaaattgtatgaaatgtgaattacagctcaacaaagctattatttaaacagacagggagaaaagaaaggaaagaaagaaagaaaagaaaagaaaagaaagaaaggaaggaaggaaggaaggaaggaaggaagaaagagagagagagagagagagaaagaaagaaagaaagaaaggaaaaaattcaaaccagcaccacccagctaagctgcttcgaaagtcctagtagaaaatatgtgaaataatgaatgcttactgttttaagccactaaattttagggtaataggttatttagcaatagataactaatatatatatcaggattaaatgagtcaactatatttattagattgcaattagtcaacattattcggtatctaggaggaactaattagtaaatgttaccttgaaataggtgagcaaaagttgctcagtcttgaagttcctgcattaactcattatgcaggtttttagacactttaagtctcattcacatatatatatatttggattagattataaattcctggaaaggaaaacttttgctgtttttataactccctttcacctatagcatccagaactttattcatcaatgcaacttatacctattgataactgatttttttttccctctaaaatgaaaagttagagaaaggccttacttatagagcagctgcctgtagatgtcactgctgaacaagggcagcgaagacattctttagtggcatcaggactctgataaaatccttctttacattcttcacagtgatttcctttgctattttcctggcagtttaaacaagcacctaaaagaagcaaattatttttaaaagttaaagatttaccttgaaagccaagtaactttcaaaaatcatgcctgcaacaaaaagatcataagaaaaagaaaaactaatagggattggatagagttaatttctaccccacctgatttctatactgccatgtctatgaattgtgtcccctactagattgtaagctccttagggaaaggtgggatacaagattagtggctcaataaatccttgctggttaatctgattacataccaaaagtagcaactatacgccaaggagaaaacaaaaacaatccaaatacatattaatagaagaatagataaattgtggcattttcataaatgaactaatcatacatgcatgaacatgcacaaatcttttttttttttttttttttagagatggggcctcccaagtggctgggactacaggagcatgccattacacccggctaatttttaaattattttatgagacaggatttcactgtgttgcccaggctgatactgaactctcagcctccagtgattctcctgcgttggcctcccaaagttttgggattacaggcatgagccattagattagccacccagcctaaatcttaaaaagaatgttggttgaaaagcaaattggggaataacacatacagaaagagaatacttattaaaatttaaaaaccacactaagcgcactaagcaaatggatacagagtacactaaccagatggatataaacatgaggtaaaaattaaaatgtggattgcgagggtataggggaattttacactctgcttgtctctgtggagggaggggggtaaaacaggactacggaggaaaagaggacctcaactttattgaaattttctatttcaaagatgtaactatatacatatatatataaatatgaagcaaaatgtcaaaatgttaatctttattattaataattctgggtgtgagtgcatggatatttgttatattattctccatagctttatatatttaaaaatttaaagtaaaaataaaaacaattaataaagaaaagaaaaaaacaaaacaaagttaggttttgtaataatactcccttggcactctattagtaaggatgttctacagacatggaagcagcataacatttgaaaatacaaaatgagaaagtgtaacataatttacattccttccttatggggccaggaagattcaaagggacactcagaactactattatggaaattagtgagtaaattctacatagaaatctaggaagataatgacattttacaaagtaagctaactacagtccaatgctaaaactattcgtaaaagtcttgatttcttttccttactagcagaaatatttttaaaaggggagagagaataaggctgtgaaataaaatggtctcacaactgaagcaaaacttgaaaaaaacaaaagaatgaaaatgtcatcaacctacatgttaaaaagctcaattttttttttttttcttttgagacggagatcactctgtggctcaggctagagtgcagtggcatgatctctgctcaccactcactgcaacctccatcttcaggttcaagtgatcctcctgcctcagcttcccaagtacctgggattacaggcgcatgtcaccacgcctggctaatttttgtattttagtagagatagggtttcactacgttggccaggccggtctcgaacttctgacctcaagtgatgcgcccatgtaggcctccctaagtgtaaatctcaattcttaactgactacagcaaaattcccccaaacttcataaatttattgtgaaagataccttcaaaagtttatgtgaacacttaacattaaatcaaacttgtatgtaaatatcatcattttcaatcatgtaattgtaaaggcctgatagtgttaatgacatttttcccacataacaaagtagtatatattcatgctgtggtagacactttaggtactggcttctttcagatcttcttgtatcatgatctctctttagctatgtatctttgtgacaataaaaaacagctgaaaaatacatactaggaaactggagttttgctctaaaaataaaacaattttaaaagttaaactgttcctcaggttggacacgtcaaaacctgcattatgtgtgaaatctgtctacctactctccccctattaaaaatgttcaatacaaagaatttttaagagaaaaagttctgataaagtgctaagctttaatataaaaaatacctgaaaaaaaaaaagctaacagttccatagtaaaatttggatgttcagggtaagatgcagtccaataataagtcctttgtgcatagctgatgtgacaagaaaaggtcatgttgctaccctttatatacatatatacatacatacatatatatatgtatatatgtatatgccaggcatggtggctcacgcctgtaatcccagcactttgggaggccaaggcaggtggatcacctgaggtcaggagttcgagaccagcctgaccaacatggtgaaaccctatctctattaaaaatacaaaattagtcaggtgtggtagtgcatgcctgtaatcccagctactcagaaggatgagacaggagaatcacttgaatccggaaagcagaggttgtggtgagccgagatcacacaattgcaatccagcctgggcaacaagagtgaaactccttttcaaaaataataataataaataaatacatatatgtaagcgtgtgtgtgtgcatgtgtgtgtacacacacacacacatgcacacacacacacttgtaatcctttactcctacagggctactgggcttatatgtttactattttggggctttttactattctaaataagactccacatgtttgtgactaccacaatataattctactctcttaagccatttataccagaatattttttccagaagaattttttatttgtgtttgttttttggccataccctgcaatgagaaatcaatgagtaaaaaaaaaataaccttacgtggtaaacaatgttatctcaaaagtaaaaatgaaagcaagtataagtataaaatttagcccaacacagtggctcaaacctgtaatcccagcactttgggaggtcaatgcaggtggattgcttgagccccagagtttgagaccagcctgggcaacagggcaaaatactgtctctacaaaaaatacaaaaattagctgggtgcggtggtgcatgcctgagtcccagctactcaggaggctgaggtgggaggatcgcttgagtctggaaggttgaggctgtagtgagctatgatcatgccactgcactccagcccgggaaatagagcgagaccctgtctcagaagaaaaataaataaattaaaaaaagaataaaattcattgattcttaaatattaatcactgtttacattgctttaaggtgcatgtacctaaagtacaactatagagaaagaaaacaaataaattaaagataggccagacataaataaccaaagtgttaacaacagtcgtgagaggcaatagccctttcagagtttttctccctctagtctagaaattatctctagtatacatgcatcacttttattttttattaccttgatttttcttattgtaaaataacacactgtaaaatatatcacatacacattgtaaaatatttcaagaactcaagcaatttgaaacacttcatatatatatttaataattatttatttttacaataaaaataaagaccataacgtttaaaacctatatacggtagaaactaatgatgtgaatttgcttctttaatagcttacaactcctctgtgagaggcaacatagcattaaaaaatggtatggggctgggtgcggtggctcacacctgtaatcccagcactctgggaggccgaggcggtcggatcacgaggtcaggagatcaagaccatcccggctaacacggtgaaaccccgtctctactaaaaatataaaaaattagccgggaatggtggtgggtgcctgtagtcccagctactcgggaggctgaggcaggagaatggcgtgaatccgggaggcggagcttgcagtgagcccagatcagccactgcactccagcctgggtgacagagcaagactctgtctcaaaaaaaaaaaaaaaaaaaaaaagtggtatgggaattaatgtcaaatttgtgttccatttccagctgaaattctcacaaactaagttaccttaagcaaacagcttctctgattttcacttttctaatctgtaaaatgggataataattctttggctaacgatttaatataatgtgagcatttcaaagggtgaaagactattccataggacataatgttttctctttatgtcttaatttcttcatctgtaaattttaaaagctgaactagatgaaatctaaggtttcctttaaatctaaaatctaagaatctttcttttatgataaatgatacataaaaataagctgaagtttaacattgttcattatgctctgcctggaaccccccaaaatataacaatactgccctaaaactcacattctcacattctcattgctgaaagatggccaaagggtggatcaaaagaaaaaggaatgtttcctgaagatgattttttcatgctccttgactaagcatctcaaaaatctttgtagagataaccaagaaaataaatagtcaaagaaaggaatgtagggctcctttccagccaaattcagggacaaaacattgaaaacatacattgttacctgcaaaaagacctttccttattcctttatttattttaccatttcatcatttatatataaacctatctgaaatacagtaatgtgctttgttgtaggaagaaatgccttaccctctttatagaacaaaaggcaagctttaacctgtcaaactgaaagaaggccagtatggagcccaggttaacaagggagagagtaacagggcataaggtcagagagaaaggcagggcccagaaaatgtaaaaccagataggccatagagagatgtttgaattttatttattccaaaagggatgagaagccattggagggcttaagcatgaaaatgacatgatctggttttacattttaaaaagattgctctggttgttatgtggagactaactgtggtggggtggggatcagagaatagggagagaagagaggaggctgaaaggccagatgagactgtgccaaagtagttcaaagagatgacagtggcttgggcaaggatgatgcaataaaagtcatgaacagtggtcagattcagggtatgttttgaagatagggctgatggaatatactgatgagctggatatttgcagtaataaaaaggagcaaaatcaaaaatgactactaggctttgggactgagtaacttggtgaaatgaatagagcaggcttaacttataagttgaaaaaaaagttgttttggatgtgttaggtatataatgccaattaaaacaagtggatatttgacagttggatatttgagtgtggagatcaacggagaaatgcaaatctgataataagcacatatatagatggcatttaaattaaatccagggttaagggggaaaatgagctaaaacaaacaaacaaatacaaattaaatccaggggactgaatgagaccacttagggagaaagtttaaatggcaaagacaaacttgacaagctctgagccctgaggcactccagtgcttggagctgaactgaggaagatgtagtagaacaaataagaaggaaaagctggttaggtagcacaaaaactaggaaagcatgatactctgaagtaagtatcattggggagtagaggattggtcaactcagtcaagctgctcaggtcaagttactcatcatgggacactatgaatacataaaggtacactggattttcaaaggaagtatattatatgaacatgaagttccagttttaaaaataatatccccccacttccattttaagggaaacgtgcttaataaagaaaatctagaaaaatacaggagtagaaaggggtaaaaaatcatcctaggaaatctctcattaagatttttaggctgggctccgtggctcaagtctgtaatcccaggactttgggaggccgagatgggtggatcacctaatgtcaggagttcaagatcagcctggccaccatggtgaaaccccgtgtctactaaaaatacaaaaattagctgggcgtgtgatggtgggcgcctgtaatcccagctacttgggaggctgaagcagaagaatcgcttgaacccgggagccagaggttgcagtgagccgagatcgtgccatgtactccagcctggtgacagagcaagactcggtctcaaaaaaaaaaaaaagatttttagtacttctctttgtaatctttcctcatttacaggggtttggcttttgttttttaactagtctaattatatggcataagttattttataccttgcttctttcactttctcatattgctatatatcattctttaaaacattttatcagccaggcacagtggctcacatctgtaatcccaccactttaggaggccgaggcaggcggatcacctgaggtcaggagttcgagaccagcctgcccaacatggcaaaaccccgtctctactaaaaatacaaaaaattagccgggcgtggtggtgggcgcctgtaatcccagctacttgggaggctgaggcaggagaatcgcttgaacccaggaggtggaggttgcagtgagccgagatcgcgccaccatactccagcctgggcaacaagggtgaaactctgtttcagaaaaaacaaaacaaaacaaaacattttatcgagaacatagtaacagttaccatttactgattacttgtgatggaccaggcactatataaaggctgtacaagtgtattgcatttaatcttcacgacaacccactaggcagttactgctattatatcaaatttatagatgaagaaacagattaagcaacttgctcaaggtaaggtcaacatttggttttctgtgtttttaataatatactgcctagataacagtatttacttaataccctattgtgagaaattgggttgcctaactttttaaaattgtaactaccattttggtgagcatctctgaatataaccttcttaagaatttagaattctttccttagaatagattcctggaaatagaactaccagatcaaagaacaatttttaagatttctaatacttactgtcaaattgctttccaaaatgtttatccaaatatatcttaccacaaaaaaagagtactttgaaaatctacttcaatctaaaacacaaggtatagcaaaacagtagagggggtgaaaataggactgtgaaaacacagtaagtggccaccagagggcaaccttatcacagcactgttgaaaataaagtcacttgacgagagtggttttatataaagcttgtaattttaaatacagtatttgcactccttcacgttggattccacttttattataattccaaacaaagaacccatttatttctctcactactagctgcttttagaaaccataaccatgaaaagaattattttgccttaaattatctccagagaaaggacaggtcagcacttacatgacagtaaagacagtggcctcgttgccttaagaaaaattaaaactgagaatcagcaatgtagactgcttttcggtactgtaaaagatctagggagtaattttaatcgactcagtataatgaagtattcctgttgttactcagtattgaaaataatctttcctctgtacgcctttccattcatttgttcatttatttgataaaaatttagtgagtagttactatatgctaaagctccatgctagagattgtgtatacaatggtgaaaaaaaaaagttcttgccctcatgagtgagccatatgtgactcagaatcacaaataaatatacaattacaaactgtgaaaagtgctatgaaaaaatacaagtatatgtgagagcatataataaggaaattaccattaagcctagagcatcaggaaatgctttctaatgaagtggcctttaattgacgactcgagggaagaatgtgatttaataaggcagaggggtcaaggatggaggtagaggtggattagaaaaaccattcttggcagaggaaagatcatatatgagaaccctgggaccagggaacatgccttgttttagaaataaaagccagtctgactggatcacagatgtaaagaaaaagaacgccacaagataaaactggcaaataggcagagacaagatcgcataaaagaaaaaaaaaacaatttcttctaaatcaatttgttttactatagagtatttgaatgaagaataaaactttcaaccgatttttccagggtacttttgacttcaagtattttgccaccctgttctcataaaaacacttgtacttgtcagactagtgtgtcctgattttttttgcttgtttgtttgggaaaaaaaatgtttccaaggaaggatacttaattcttacatttaggaaaactaagatcagaagttaattggctttagtttttaatggtttgactaagtttgcctaaatgtggttttctttgttttatattgcttagggtttgctgaactttctgaatctgtcggttgacacctttaatccatttggaaaattcatggccattttctcttcagatattactgggatccagtatcactttcctctctttttagatctccaattacatttatgctaaaccttttggctgtgtcccacatcttccctgctctgttctttccattatattttctcgaaatgcttcagtttggatatttttaattgtactgtattcaagtcttctaactttgtcttcactgtgtacaatctactgttagattaatgcaatgagttattaattcacatgttgtatttttcagttccagtttgttcatttgatattttagagattccaatttctattgacattttgcctctcttcacctattttgtctgattttccctttattgtatgaaaatactaactttagtcaagtctttctaagttgactctaacacctagatcacctaaaggtctgcttccattgctcattttttttctctttggtattggtcacatttttctgtctttgcattgtccagtattttttattgtatgccggacacagtatataaaagaaccagagagggctcccctttcatctgttaggcagatataatgagagaattacttcaatccaatcagaaggtgaggcggcttgagggtggactgtaattttagtatgagttaatcaacttctggttccttactatttcttggtcagagcctagcaagcctgtgtctccttagccctaaaagactgtgagagatttgtattggcctttggtaatttgagcttaggtcccactgcatgcaccctcagagtctgaagacatcttgagggggagataattgaatgtcatagcaggccctctctttctaaagggattttgtctcctcagcacaagactgaaagagaaagagatttttttctacctttctggcccagccttccatcttttgcatagtcggctaatatcctgtgggaaagctggccttgtgtttggggatcctcttgtttccaaccatcatgcaagcctcaaatgactgccaaaaacatttcttgtatctctttcctaaagaattcctttgcttgggtctagctcattctttgcctatgctcagaatcagcaaatgtcccctggaaagacaatggctggtgatcatcagtttacctaggaagagttccaacctttctggaattttagttcctatagttctccttgcctccataggtatatgactttttttttttttttttaatttacgtactttttcaagtttgttgtagcaggagtttggcttgctgtgatctagtacatcctacttagaagataaaggcccttccaaactatttcagaagaatcaacctatagctgaaagatttccaaattaaaagaacagtggaataattacatgacaaagttaaggaaagtacgtacctgtgagggcatcgcaactggcagaccgattattgcattggcagggcaagcagccattcttactaaagccataatatccatcttggcatcggtcacatatagagccaatgacacccactttgcactggcatttcccagaactgcaaataaaagcaaagacaatgaataaaagtaaatcaatttaaaagttgtattgagtaacaccccagaagggaaagaaagcccagctcatgtaaatcatatatacttaccatatctcaaagccttgtgtccaaataaatcacctatcaaattctgtattgctattaaaagctgtctagtgtattgcataatgcaatttcttagctaacaaataattttacagaaaatttaaaatggaggcatttgaaagcaggagtaataatgatgatgcaatgagctatcatttattgagggcttatgtcaataaatatattttttctctaatcctcaaggtagttctacctggtgagggtcataatacttattttactactgagaaaattcagataaagttactgtcctcagctagtaagtcaagtctattcatacaaagccagacttttccccaccatactatctactcctaagattgactctaaattggtacaagaaatttgtctgccaaataacttgatatccacttaggtatcaagcttcattctgtagatccaaagcattacaattcaccatctatataggtcctgactccagtgatggtgtttatgccctgtccacaataaatcttgctctcttttctcactgcaagtaaatttcaggtctttaacaaaggctgagaaatcttattgcttgaagagaagctgcagcctaacaaagtcaaaggttctcagagatagaagcccaaatattttgatgtttaaagcttaaataaaatttgtactgatcatagtataggagatgtttttaaaaatgcaacaaaaatttacattatctaatttatactatcaagcatgaatctatgaatcttaagtaatttagtaaagaaaaaagaaaagaagccacacacatatacggtcttacacaagaatatcccaaggtacttaaagatctagcaaagaaaacctgtattcataaaaaataaaattcaggaatattttatgactcaataagaaggaaccagtcaatcgaagccactctatactatcagaaaattataaagaacataatgtacctttcaaagaatggcttacaacacttcatcagcttatttccaaggcttttaaaatgttaatcaaaatatgcttactcctcattcctctaaatatgttattcaatatacaaaaggataaacagttactttcaatgatggtgtttgcctaacccacaacctacaagaagaaggtattagtttcgaacacaaaatcacttaataatattgtgtaaccataatatagccaatgttcccaaagtagttgctattcctgaagtgggttttcccttaataattcttggggcactaaaagactttctatctggaggatctgctccttaattgctgatttaaagtgacttaatgaatcttgataaagtagttgtctgagtgtacataccatgctttattttttcctgggtgatttttgttcgtttttgttttttgagaaagggtctcatttagtcccctaggctgcagtggcgtgatttcggctcactgcagcctcaacttcctgggttcaggtggtccttctgcctcagcccctcaagtagctgggactacaggtatgcgccaccacatccggctaatttttgtattttttgtggagacagggttttcccctgttgcccaggctggtctcaaactcctgagctcaagcaatccgtctgccttggcctccgaaagtgctagcattacaggtatgagacaccatgcatggccagattttaaaacaacaagaaaaaaaaaggtgcttttctctcttttaaaagaaaatataggccgggcgtggtggctcacacctttatcccagcactttgggaggctgaggtgggtgggtcacttgaggtcacaagttcaagaccagtgatcagcctggccaacatggtgaaaccccgtctctaccaaaaatacaaaaattagtcagagtggtggtgtgtgcctgtagttccagctacctgggaggctgaagcaggagaactgcttgaacccagaagacggagggtgcagtgagccaagatcatatcactgcattccagcttgggtgacagagtgagactccgtctcaaaaaaaaaaaaaaaaaaaatgaagtgaggaattttggttgtgaggctgcactactagtgcttttgcatcatgttattcatggcccaaggccaatttctgcatgtataagaattaaatttatcaggcatggtggcacatgcctatagtcccagctactcaggaggctgaggcaggaagatcacttgagcccaggagttctaggctgcctgaactactccaactgcagttaaacaggaataaacagctgggtccacttatctcaaattaaacctgtctctcataaagccccacagaccaagaaacacaggagactaatcctgcaaccacccaatgggttcaccttgcccactgcctaggcagagctgatttatcaagatgggggaattgcaatacagaaagagtaattcatgcagagccagctgtgcaggagaccagagctttattattactcaaatcagtttccctaagtattcagggattagggtttttaaggacaacttggtgggtggggtgaaaccagggagccagaagtgctgactggttaggcaggaaatgacatcacagggaattgaagccatcctcttgagctgagtgtgccatgatcgggcctgtgaatagccactgtactccagcctgggcgacacagggagactctgtctcttaaaaaaaagatttaaatcggccaggtgcagtggctcatgcctgtaatcctagcactttcggaggctgaggcgagtggatcacgagggcaggagttcgagaccagcctggccaacatagtgaaacctcgtctctactaaaaatacaaaaattagcagggcatggtggcacacacctgtagtcccagctactcgggaggctgaggcaggagaatcgcttgaacctgtgaggtggaggttgtggtgagccaagattgcgccactgcactccagcctgggtgacagcaagactctgtctcacaaaaaaaaaaaaaaaaaaaaaaagaaagaaaagaaatcactcagcaaatataaagctttgcctgtgtgacttccttcgtagaataaagactttacaacactccctttcatggtctctctctgttaaagacttgaatgctttctgaagcaaaggtcaatgatataaatgcaatgaaaccaaaaaagaaaaaaaaaaggctgtgaacagaccacttatgcttatccatagatttgaaatgaaagaaccaaaacccacagcttcataactggagaataaatgtgtagaactggattttaaatagaaatcagacatctgtactatgagatcagctaacaatttaagataaaatttgcttatctggtcttaatgacatgttgctagtaaagtaccaagatagcacaaaaattatatcagaaaaaaaagaatatagaattattcataaacgaagcataagcattgtggagctacgctgcattaagtgtaactatgcatatactacacatttcttaaattatcccaaaagggattctcagattttcttgtggtagtaatgctcagttatagaacttacatactcatgggtgtgaacaactcctgcaaggttttaacactttagaaaaaagcattttttaagtgtatataaataaaaacatattttacaacactaatagtcattactttttcaaaagaaaattcactggtgtatcatctcaagatatggtacatatctatgtcacatgaatacaagccaaattacctttttaaagactctgtttaagatgagtgggtggagaagcttcagaatttccattattttacagtcacattgattaggtgggatgggtataatacaggaaaggagtatcagagtttatggaaaaaaccagcccgaggaaacagagtttggttcatattccagctctactagtgactagctggcacaaagtattcattctatcttggcctctgtattctcatttgttaagtgaagacaattataccaacctttgtagtatattaaaaattgcatacacaatgcatttagcacagtgtctggcacatactcagtactcaaaaatgaaagcaactatggacatgatgacagtgatcctagatcttaaatattttctgagaattctaaggaaagtaggttagaattcccagttggcaaagacagggaagactaagttacttacttttaaaatttaaaatttgtaagtaatttaaaattttagaattctgttaataaaactaaaaaaaagcaaaacattaaaggataattactagtttgtagcaaaaatatggctagaaaaagagagcacattataaacacatggtagaaacagttttgggggaaaaaattttaatcgagaagagaaaggatctgcaaaatcctacattaggtgggatcaaagccagctggacctgacttgcttttctaccaactagttaatgatttatttctaaattgttaaatgtcttggcatgttttttgttatcaagaaagtctattttcttcctaagatttacaagatataaagtacgtgtgtatgtatatttttaggtatcacattatcaattttaactcaagcagttacagaataattaaaaattatacatagttctttcctttttcttttttttgagatggagtcttgctctgtcacccaggttggagtggtgcagtggcacaatctcggcttactgcaacctccgcctcctgggttcaagcgattctcctgcctcagcctcccaagtagctgggactacaggcatgcactatcacgcccggctaatttttgtatttttagcagaaacagagtttcgtcatgttggccaggctggtctcgaactcctgacctcaagtgatccacccgcctgggcttccccaagtgctgggattacaggtgtgagccactgcgcccagcccatagttctaattagagaaaattaattcatttgtggtcatttgggaacttttgcttttcccctttccttcttcctcagacattacacatgttgacactctgacatgaagacaataagaaacacaattaagagataatgaaatgtatcaattttcttcttcctccacttttaaaaatgaacttaaaaataacattttaagctatttttaaataactaaaaaacaatttactttgggaagagactgaaactagtaattaaaagtctgaaatcagtaataccaaactgctgattataaactcgctcaatatattaaaatcgaactttaaaaggtagctagaaaaagtttttccaactacaaaaaggttttatatggaaaaataaaataaaacgttattaaaaattcttaatttcatgtctgggtcatgattttgtagaggtaagaaaataatagtttctcctcttgttaaaagaaacttaataattggactttctggcaaaagattatctgaatttagtgttcctctgtctttccacagttatggaaaagatcattatgcaataagcgaggcttctggaggaaaaaaaggatagctttattgttgaaaacattgggctattatgctaaacattccttgtatttttgagggcaaatagtctaaaatatgtttagaggaaatccatattcagacagaaattcttgtcgttgtttttttttttttttttttttttttttcagagacagaggacagtttattcctccaaacaaaagcagtagctagagtagagtatcagcatttacaccatgtccccaaacctcaattcccaacggtcatgcaacgagggccagtgatgcctgcatatgaggtgggttgttacagaagaagaaccccaaactcagagaatccaaatcttttataatggacagtgagcttacctgatctttgcccaggagggagactttatttttattatattggacagtggcaaatctgttctttactccagaggaagatattagctctattttccaaggcagtttgctatgcaaatatccttgaataaatagtccagaacaaggcagtgcctctgcttgcaaaagcacaagagatctttagagaattgtcttgaaacaataaccacctctcaatgatacaatctcatagcctctgaaaacttttctcatgagtacaacactccagtcatgatgactttgttttgttttttgttttttgatacagggtctcactgtgttgcccaggctggagtgcagtggtgcgatcacagctcactgcagcctcaacctccctggctcaagatatcctcccacctcaatctcttgagtgtggaactacaggcatgtgccaccatgcctggataactttttgaaatttattttttgtagagacaggttcacattatattgtccaggctggtctcaaactcctgggctcaagcaatccttcagccttgttctcccaaagtgctgggattacaggtgtgagtcactgtgcctggcccagtcatgatgattaatctgaacaacagagccaaatcctgcctgagacacattttaaataaacttttattggaacacaggctaggtgcagtggctcatgcctgtaatcccagcactttgacaggccaaggaaggcagatcacttgaagccaggagttcgagaccagcctggctaacatggcaaaacatcgtctctactaaaaatacaaaaattaatggcatggtggcacacggctgtaattccagctactcgggaggctgaggcatgagacttgcttgaatctgggaggcggaggttgttgcagtgaggcaagattgtgccactgcactccagcctgggtgacagagtgagacagtccccaaaaaaatttttggctgggtgcagtggctcacatctgtaatcccagcactttgggaggccaaggaggatggaccacctgaggtcaggagttcaagaccatcctggacaatatggtgaaacccgtctctactaaaaatacaaaaattagctaggcgtggtggcacgcacctgtagtcccagctactcgggaggctgaggcaggcgaattgcttgaacctggcaggtggaggttgcagtgagctgagatcgcatcactgcactccagcctgggcaacagagtgagactccgtctcaaaaaaaaaaaaaagaaaagttttattggaacacagtcattaatttacgtattgtctatggctattttcactctttaatggtacagttcagtataccttgaccatccgcccattgctgagtagccttttttgctattatttttaactgacaaataacaattgtacatatttatggggtacagtgtggtatgtcaatacaaagcctatatgtatactttcatatctgttaaccaacctttggctatcttcccctcccaccttttctacctttaataaccactattctactttctacttctatgagatcaacatttttagttcccacataagtaggaacatgcagtatttctgcatctgtctgacttcacttaagataatgttcttcaagttcatccattgtgccatgaatgatagaatttcattcttttttatggctaactagtgttccattgcacacattttctttagccactcttctggtgatggacacagaggttgattctgtatcttggctattgtgaagtgctgcaataaacatgggcatgcaaatatctctttggcatactaacttcctttcctatagatatacacccagtagagggattgttggatcatatgatagttctatttttagttttctgaggaacttccatactgtttttcataatggctgtgctaatttacatttccactagaacagtgtataagagtccccttttctctgcatctttgccagcatgtattctttgcctttttgataacagacattctaatgggggtgagatgacatctcattgtagttttgatttgtacttctctgatgattagtgatgttgagtacttttcatttgtatgtttttgtttgagaaatgttaattcagctcctttgcccatttttaaaattatttgtttactggttgttgaggtgtttgaagatatctggatattagtctctttcagatgaatagtttgcaaatatcttctcccattctgcatattgtcttttcactctgttgattgctgcctttgctgtgcaaacgttttttaactggatccgatcccatttgtctatttttgcttttattgtctgtgctgatgaggtcttcacaaaatctctgcccagagcactgccctgaaacatttcttctatgttttctgccagtagtttcatagttttcagtcttgcatttagttctttagtcaatttggaaacgatttttgtatatggtgagagataaaggtctagtttcatttttctgcatatggatatccagtttccccagcaccacttattgaagagactgtcccattctcaatgaatgtttttggcacctctgagaatcaagtggctgtaagtatgtggattcatttctaaattctttattccattccattagtctatgtgtctgtttttatgccagtaccatgttgttttggttactaaagttttgtagtatattttgaagtccagcagtgtgttgcctccagctttgttctttttgctcagaatttgagtatttgaggtcccctgtggttccatatgaatttgattgcatttttttttttttctgagatggagtcttgccctgtcacccgggctggagtgcagtggtgcaatctcaactcactgcaacctccacctcccaggttcaagcaattctcctgcctcagcctcctgagtagctgggattacaggtgtgcaccaccatgcctgggtaatttttgtaattttagtagaaatggggttttgccatgttggccaggctggtcttgaactcctgaccttaagtgatctgccagtctcagcctcccaaagtgctggcattacaggtataagccactgtgcccggccctgtattttctatttctgtgaagaatgccatagatattttgatagggatagcattaaatctgtagatcacttttggtagtatggttattttcacaatattaattcttcttctccttctccttcctcaccttctccttctccttctcctcctcctctttttttgagatggagtctcactctgtcgccaggctggagtgcagtgatgcgatctcagctcactgcaacctccacctcccaggttcaagtgatttgcctgcctcagcctcctgaatagctgggactataggtgcatgctaccacgcccagctaatttttgtatttttagtagagacaggtttcaccatattggccaagatggtcttgatctctttacctggtgatccacccacctcggcctcccaagaacccagaccacaatatgaattctttcaacccataaacatagaatatcttttaattttttaaatgtcctaatcaatttcctttcatcagtgttttatagttttccttgtagaaatctttcatattcttggataaatttattcctaagtgtttttttttttttttggagctattttaaataggattggttttttaaatttctttttccactatttcactgttgctgtgtaaaaacagcactgattttttatgttgattttgtgtcctccaactttactgaattcatttatcagttctaagagctttttggtggagcttttagggttttctatataaaagatcatgtcatctgcaaacagacaatttgatttcctcctttccaatttggatgccctttatttctttctcttgcctaattgctctggctagcacttctggtattatgttgaataggagtggtgaaagtgggcatccttgtctttttccagttcttaggggaaaggcattcaccttttccccactctgtatgatgctggctgttggtttgtcatattggcctttattattctgaggtacgtttcttctgtctattttttgagtgtttttatcacgaaggaatgttgaattttatcaaatgctttttctgcatccactgagatgatcatgtggttactgtccttcattctgttgattgatgtatcacgtttattgatttgcatgtgttgaaccacccttgcatccctagtataaatcccacttgatcatggtgtattttctttttaatgtgttgttggatttggtttgcaagtattctgttggggatttatgagcctatgttattcagggatatgggcctgtagttttcttttttgtgttgtgtccttgtctggttttggtatcagggtgatgctagccttacagaatgagttagggagaattcccttctctttgattttttggaatagtttcaggaggattagtattagttcttcttcatatgtttggtagaatttggctatgaatgcaaccagtgggcttttctttattgggaggctttttattgctgattcaatctcattacctgttactgggctgtccaggttttccatttcttcctgattcagtcttggtagcttgcatgtttccatacaagcagaatttatccattttcactaggttttcagatttcttggcatacagttgtttgtaatagcctctaatgatcctttgtatttctgtggcatcagttgtaatgtcctctttttcatttctgattttatttctttaggttttttctctttttttcttggttagtctagctgatggtttctcaattttgtttatcttttcaaagccaactttttatttagctgatttcttgtattgctttttagtctcaattttaaaatttttgccctaatctttattatgtctttccttctgctaattttgagttttgttttttctggcttttctagttccttaagctggatcattaggttgtttatttgaaattttgctagttttttaatacaagtgtttattgctataaagtttccttttgatactgtgtttgctctatcccatagcatggtatgggatgttgcgtttctattttcatttgctccaagaaattttaaaatttcctcattgatccagtggtcattcaggagtatattaatttttgtgtatttgtatagctttccaaagttcctctaattgttgatttctagtttgattccattacagtcagaaaagatacctgatataatattaattcttttaaatttgttaagacttgtgttgtagtctaacatgtggtctatcctggagaatgttctatgtgctattgaaaagaaaggatgtacattttgtagcttttggattaaatgttctgtcaacgtctgttaggtccatttggtctcaagtgcagtttaaatcaaatgtttccttgttgattttctgtctagatgatatgtccaatgttgagacgttagatattgggtgttgaaatctgcaactattattgtattggagtctaactctcactttagatctaataatatgtgcatatgtgggtgctccagtgttgggtgcatatatatttacaattattatatccttttgctaaattaattcctttatcactatataatgaccttttttgtctctttttacagtttttgacttaaagtttgttttatctgacttaggcatagctatttctgctcacttttggtttccatatgtgtggaatatcttttttttttttttttttttttttttttgagacggagtctcgctgtcgcccaggctggagtgcagtggcgcaatcttggctcactgcaggctccgccccctggggttcacgccattctcctgcctcaggaatatctttttccataactttactttcagtctgtgtatgtctttacaagtgaagacaatttcttgtaggcagcatatagttaggccatatctttttatccattcagccagtccatatcttttaagtgggggatttaatctgtttatactcaaggttattactgataggtaaggacttactgctgacattttgttaattgttttctggttgctttgtatatccttatttcctttgttctgcctttattgtttatcattgatgtttggtggtttttttgaagtgataaggtttgattctcttctctttctcctttgtccatcttttctaacagtgaatgttacacttttgtgttttttcataatagtgattattgtcctttcacttacagatgtaggactcccttgagcatttcatgtaaggctgttctagtggtgatgaattccctcagtttttgcttatctgggaaagactttattcctcccttatttctgaaggatagcttttctgggtatagtattcttggttcactttttttttccttttagcaacttgaatatatcaacccattctttcctggcctgtaagatttctgcagagaaatctgctgttaggttaatgaagactcccttatacatgacttgacacttttctcttgttgtgtttagaattctctctttgtatatgactttgaataatctgactattaagtaccttggatgggatctttttgtgtgaaatctatttggggaccactgagcttcctgaaactggatttccaaatttctccacacgcttgggaattttttagctattatttcattaaataggttttctatgccttttcccttccctagaactctcacaatacaaatacttgttcacttaatggtgtcccataagtcttgtaagctttctttactctttttcattcatatttctctctcttttttttttcctctgactaggtaatttcgaatgacctatcttcaagttcagggattcttttgctggattctttcttttgttgaatctctctgttgtattttttaatttaattcactgaattcttcagttgcaggatttctggttggttcttttttttatgatttctatctctgttgaatttgtcattcacatcataaatccttttctgattgactgaactatctgtatttccttgtatatcattcaatttcttaaaaaatcataattttgaattccttttctggcaattagttgatttccttttcatgcaggtctgccactagaaagtgacgttcctttggtggcaacctatttccatgctctttcatatttctggtgtccctgtgttgatgtctgtgcacctggtggaacaatcatctcttccttttttttgagatgaagtctccatctgtcacctgtgctggagtacagtggcatgatcttggctcactgcaacctctgtctcccaagttcaagcgattctcttgcctcagcttcatgagaagctggaattaacacgtgtatgtcaccacacctggctaatttttttggtatttttgtagagatgggatttcgtcatattggccaggctggtcttgaactcctgacctcaagtaatccacccatcttggcctcccaaagtgctgggattacaggcttgagccaccgcgtccagcctacctcttcctaactttctagagtggcttccatagataaggactttcatctgcagttgggttttagtttgctggttgaaaaggtggtggtgactctgtttccaattgggtgcagtggtatagtcttcatgaagattcttcatctttattcaatgtcagcaataactgtaagcatctcagtggcataggctgtacacatttgtgacagtggtggccagaaattcataatactcaaaaagagtactgcttaagtgcaaaaatattttgtgataactgatcttatcaaaataaaattcaaaaatttaaaaactcagaagtaaaacttaaaggcataaaaatcaaatgtgacacatttccagagccacaacttgcaacagttaacttaattcaactaggacagtgatttttcacttccttcactgttttttttaaaacagaaaaaatacaagcataaaaatggtgctccacacctctgcccagccgcgaccccgtctgggaactgaggagcgcctccgcccggccgccccatctgagaagtgaggagcccgtccgcccggcagccgccccgtctgggaggtgggggggcgcccccgcccggcagccgccccgtctggggggtgggggggcccctctgcccggccgccacgtctgggaagtgaggagcccctctgcccggccgccaccccgtctgggaggtgtacccaacagctcattgagaatgggccatgatgaccatgggggttttgtccaatagaaaagggtgaaatgtggggaaaagagagatcagattgttattgtgtctgtgtagaaagaagtagacataggagactccatttctgtactaagaaaaattctgccttgggatgctgttaatctataaccttacccccaaccccatgctctctgaaacatgtgctgtgtcaactcagggttaaatggattaagggtggtgcaagatgtgctttgttaaacagatgcttgaaggcagcatgctcgttaagagtcatcaccactccctaatgtcaagtacccagggacacaaacactgtggaaggccgcagggtcctctgcctaggaaaaccagagacctttgttcacatgtttatctgctgaccttctctccactatcgtcctatgaccctgccaaattccccctctcgagaaacacccaagaatgatcaataaatactaaaaaaagtttaaaaaaaaagagagaagaaattttaaagaataaagtatgtattctgctttaaaaaaaaaaaaaatggtgctccaggccgggcgtggtggctcatgcctgtaatctcggcactttgggaggccgaggtgggtagattatgaggtcaggagttcaagaccagcttggccaagatggtgttaccccatctctactaaaaatacaaaaattagctgggcatggtggtgggtgcctgtaatcccagctactcaggaggctgaggcagagaattgcttgaacccgggaggcagaagttgcagtgagccgagatcgcaccattgcactccagccagggcaacagggcaagactctgtctcaaaaaaaaaaaaaaaaaaaaaaaaaaagtactacattatttgatagtttctgcacttcataagtcattttgaaaaaagaaaatgtagagacaaaatatagggtctaggtatcttgccaagaagttgcttctcaaatatgttaatatttgtattcttttgtaaccattgtaaaagagatgtttagtgaaagggtaaatttttttttaacctttttctttttttgagacagggtctcactgtcacccagactgaagtgcagtgatgcgatcacagctcactgcagccttgacctactgagctcaaataatcatcctgcctcagcccctctgagttgctaggactataggtgcacgctgccacacgtggctaatgttttgattttgtagaaacagggtctcactatgttacccacgttggtctttaactcccggcttcaagtgattctcccacattggcctcccaaagtgctaggatcacaggcatgggccaccacacccagctgaaaaagtaattattaatacctaatttttgtatttgctgtattccaaaaattaacttgtagtgcctataatttagaactcattttctcagagaaacgattgcataaatggtggcttagtttccagatcagcaaacaaaaacctgcttaaattgaaacattactgacagggttgaagcctaagtcctttatacccaagttctaagtctttgaggtttgaaccctatagggggtagagtagtcagtaggcaatatttgggcatgatcaattttactgggcaatgcctattttccaacagggtggtaacaatttatactcccatcagcaacggaataatggtctcactgttctatattctcgccaatacttgacgctatcagcttttacatttttgccaatctggcaccttgaagtagcatcacaacatggttttaaattgcattcttctgattagtaatgagatggaacatcttttcacccttactggccatttgagtttcctcttttatgaggaatctgcccaagtattttttgtttgtttttagagatggggtctcactgtgtctcccaagctggaatacagtggcacaatcatagctctctgcagcctcgaactcctgggctcgagcaagccttctgcctcagtatcctgagtagcttgggcttaggtgtgcaccaccatgcccagcttgtccaagtatttttgacattgacttgtaaaaattctttatatacttctgtaaaagtaatcatctgtcagtttcatatgctgtaattatcttctctcagtttgtggcttgtcttttcatttcatttataaagtctcttgacaaacagaagttttcacttttaatccagttgaatgtataaatatttcccatatgttttttatattttggagagtattttagtgaaatagttaagagtaggaaccctgggcagggcacggtgctcatgcctgtaatcccagcactctgggaggccgaggtgggtggataatttgaggtcaggagtttgagactagcttggccaacatggtgagaccctgtctccactaaaaataccaaaatgagccgggcatggcggcatgcgcttgtaatcccagtactcgggaggctgaggtaggagaatcacttgaatccgggaggcagaggttgcaatgagccgagattgtgccactgcactccagcctgggtgacagagtgagactccgtctttaaaaaaaaaaaaaaaaaaaaaaaaagataggaactctggagctagaatacctagattaaaatcctggccactagtcatatgaccttaaataaattacttaatctctttatgcctcagctcctcatttgtctaacagaggacctatctcacaggtttgttaagattaacttagttaatatgtggtaagcacatatatagaacagtgcctgactcagagtaaaaactacctaagtgttgctattattttagtattattgttgaagaaatccctctctaccccaatatcattttacattttgtctttcacatttaggtctttgatctacctgaaatttatttttgcataacatataagtgaaaggttcaaactcattttcttcctaatagatagccaaaactctagtacgattcattgataaatccaccctttatgcccctaagctttagtacctcctctgccatatatcaaatgtctttatacatatgatttacttctgggctttcttttttatctatttgtttatcctgaaccaataccaccctgtctagattactatagctttacctctctccaatgtttctgtataaaaactttggaaaatatagataaatcaaaagaatggtattctggatatctgtgtatatattttgctttacatactaccccctaactcctgttcccaatttataccacttcagccacaatgactttgctgttgctcaaatacatcaggcatcttcctgcatcagggactctacttgctgttctctctattggcaatacttttccacaggggatccgcatggcatgctctattacttctttttgttccttattctaatgtcatattctcaacatatcttgcctagccacactatctgaaattgtaatatttcttactatttaatataccataaattttattttcttgtttattatctctcttcccatctagaatgtcagttctgtggaatcaggggggttttatgtgttttttcctctgctatattcccagtgcctagcacagtgcctggcatgtgataggcatgcaaactttgtttaatgattgcataatctggctccaaagtctatgtgtgctttcttcattaactcttgatgacttctaagcgcaatatttattttcatttcagtccatttaatattttccatgtacttaatcttttttaaaattttattattcttctttagacttttatcgacttttttcaggggctacatatgcaggttggttacatgagtaaactgtgttgctgaggtctggtgtatgaatgatcccatcacccaggtagtacccaataggtagtttttcaaccctttaccccccgcccaccctcccccttctagtagtccccagtgtctactgttcccatctttatgtccatgtgtactcaatgtttagatcccacttataagtgagaacatgtggtatttggttttctgttcctgcattaacttgccgaggataatggcctccatctgtatccatgttgctgcaacagatatgattttgttcttttttacagctgcatagtattccatggtgtatatgtaccacattttctttatccattctacaatttatggacatcaggattaattccatgtctttgctattgtgaatagcatgcacttaatcttgacactttatgtcacacttaaataaacctcttagaatcttggaaatagaatattcattctaggtgagcaaaatgagacattcaatgactagcccatgataggccaatcaaccttgtaagacagtgatccctcaggtttgttcattaaagtaagataaagaagagcagatagaaagaaaaagtcctagccctcaaagaaaaatccattttgctcaaccccaatattccatcatgaccctactgaatagggcctctttagcttatacaattctcataaaaacaaagaatagaggttgaaatgcctcaaaaaaaacccttctttcttagttctagtttgcatctgcataagttgaccttaggttttgaggacaacacactcagagccaccaacatagatcagtggttctgaaactttagcatgctgattcttgggccctatcccagacttttttattcaataggtctggtgttgggcctaggaatttgcatttctaagcaatttccaggttaaactgatattgctggtctggggaccataattagagaactactctactaaattaactgtacttatttcactctattttttatatccctatccctgactggtaaagctacttactttccacttccaggcatagtgatgaaccctgaatttggtatcaattctaacctaagaagagggtacttaaggcaatcaacctcagcggtctgtcaagtcccatttgctactggttcctttgtcctcagtcccctatattcctaatgattaattacaactattgtccctagtttctcaatgcctggctcctggtctcagtggccctgcctctccactttccaccacaatgactaggtccatgacacttgctttcagacttctcacatatcaaatgcctgccttttaacttaaacccaagcaagtcagatgttctgacacccaaaccacagacctagctttaaatatttctaatgccctaattcctgccttttcctttccaatgattctgtatgtatactcttaacaatttttattgttgccttctgttcagtatttattttcattgtagcccaggtctgatttctagatttatatttccataggccagtacctaaactgatgagtcatactcacccacagctagccttgcacttacattgagatgctcacactgccatatctaattttgcctattctatttcagggtacagtgggaagagacttggagccggacagatctgggctcaaatctaagttctgccatttattagttatgccatgtcgctaagtaatttagctgctaagaacaaaatggatgagttgtctgagaagtcagagaggttttatgtgtaaaacatcaagaatggaggtttaaagtgttcaatgaatgttaatttccttctgttcctcctgctgcctctcctggattatgcagcttctttcggtgaacatgttagtcaagaaagctaatatatttctctgtaaaaatgtttccttcaaatatccacaatatctgttttaatggacattctattcaattgcagaaccctttgaaaatcaattcaaggccagcaaaagtaaaacttaattaaagtaatggtcatggtatatgtgttggaaactggcaaaagagaaggaagagattttgttattgacaatataagccatacttgcattactgcttttggcaatgtgagaaacatgcctatgttccttctgtagtgtatgtagaaaaccccaaactgaaaaactaaattgaaaaccccaaattgttgaaacacacaaaatatatcacaccagaatattcatttaatctacacaaagccataataatggaatttataatttttaaactagtcctatatactatgtcaaaataatcatggctgaagcatttgtgtccctttttatggaaaatctaaagaaacttcaagtccaagtctccctctaggattgacaaatttaggtattttgagaagaaatcacatccagggaggaaaaaaagctgaacagtcccatatttatctccatcctctaggaaacatatttcttgctatgaaaaaaaaaaaatctgagatggaaaaagtcatgctgatttaattttctttcagggaatagagaggaagacaaagccttctctgtgggaacaagaggccttctattttagcctaagtctactaacatgagtcttagaagctattcattttaaactgcagagaaaaaagaacattaaaataggctatgaatttgattgtacattctaaccacaatgtcatacatctaaaatggcaggtcaacaaagtaagtttatttccttatcctaatttctcttctgtacttaaggctaagaattaccataaggaccaactttgccctcaaataaataatactgtctatactcccttgaatgactgcttcaaataacaattttattaactttctattttgaaataatattagatttaaagaggagttgcaaagatagtacaggaagttctaatctaccattcatccagcttccactaatgtttcttttttttttctttttttttttgagacaggatctagctctgttgcccagactggtgccatcatggctcactatagccttgacctcctgggctcacgcgatcctcctacttcagcctcccaagtagctgggactacatgcatgcaccaccaagtagctgggactacaagcatgcttgactaattgtgtaatctgttgtagagatggggtctccttatgttgcccaggctagtctcaaactcatgggctcaagcgatcctcctgccttggcctcccaaagtgctgggataagaggtgtgaggcaccatgaggctcggcctgtttaacttcgtatgtaatcaggacatatttatcaaaaaggagaaattaacaatggcacaatactattaactactcagatttccctaatttttctaccagtatccattttttcggttccagaatccaatctaggatattgtctcgcatttactcgtcatgtctccgcagcctcttccaatctgacagtttctcagtcttttcttgtctcttatgaccttgaagcttttaagggaacttgacaagtattttgtgaaatttccctcaatttgggtttgtctgatctcttgtcacaattagaatgaggttatgaattttgaggaagactatcacaaatgtaatgtatctttctcatctcatcacattagggatacataatattcatgacatattgctagtgatgttaccttgatcacacagaggataatttttaatgctaggaatctgtttgtatgatagctaaacttaaaggatggctatcaggcttactgaaaataagcagtggttcggccaaccaattaacaaacactaggacccactgaaggcaggatagtcagacagatattaatttgagccagtttctgccacttattagttgtctgttttggggcaaattaagcctcagtttcttcatctgtaaaatagaatatatcaccttcaattaactgttattttatccttacaagacagtaaatataaagcacttaccctggcacatagtaaacagtcggtaaatgttagtgctgttcattctggagttgatagtggtagtaataatgtcagaagcatttgtcaagttgtgtggtatttttgtctcagaaggaagtcaaactacagacaggaaaacactacatgttcgtaaggttttaaaacacattaagtatagtaaaatgccctataagagagatgtttataaagattaaatttgtagttcctttcttctttagcaagagaagtgtgcaattgctttgccatttgggtagaggtaggaaaataaccctgaagcagatcctcctgactgtgaaaaatcatttaagttgggtttcctttagttacataagtatagcatgaacaggccctactgtcctgagataagggtttaacaagactctttatattttgagtgactaaagaaaggcgcttaagccctggggagggaagaaagtttgaggtttgttagtgaaaagattctacaaaatgtcctcaaaaagtactcttgggaccggcttacacaatgagatgtggctgcatatataaactgaaggagctgattgttaagatctagaacctaggagacctaatttagagcatccttgaaagaatgtggcattaagggattgggttcatcctcccttaaagaatcactgctgcctctgcaaggatctggaccagttaaagcatcatcacagttgtgagcaagcatcatccatccattaggttgttcagggaccaggcttcaccccaacaattccaggtagcagtgagaaacagtaggattagtgaactgatcagaatcacattccttttatacctagcatcacaggaggactgacccctagagttataggacaattagttacctgttgataatgtgttgcatcaagaggagagagtacttgactttatgctatttaggcatatgagggccagagcaattaattggaaaaataaaagaagtaaagtttgtcaattatataagctttcaactttccaatatctattgtttgctaccctcaaaggcctccttataaagattaacagttttaaaaactcttaaaaggtaaagggcctttggatttcttttcagtaatgcagaaagaatgtggatatggggacactgcttgacactcagcagcaaggctaatgcaggaataaaaatcccatgggatacagtgggtggtagcaattgctggagcataggaaagcagattcaattcctgcagcctgcaacaaaggaagaatggtaagcacagggagagggtgtgggcctgagaaggaactttgtgcctaagcatttccataagttcaacttagaaatacaaactacctttagatttgtatgtattaatgcaaaaattacaaaatttccacagaattatgcacagaaacatggctgtcatggcgtatcacccttctgactcttctgactactctccatattttaaatattctccccattctcactaatattaccctaattttggcccttgttagtttttactctgcctccaatctctccctacttacatctactcattctcctactgctacaatccagtgttgatctttctcctgcttaaaaattgctttgtgaataaaacccaaatcatccgtctggccctaaaggctccctgtgacctgaccccaacaggacttaccagactcatctcctgtccccactcctcttccacttgacatcttcagtaagcccatctctgagatgttaatcttgctgtttgctgtctgtaaagtcctttctcatcttttttcacttctgtatgtctaaatcctttccttccttcaaagctgggatcaaaagctacctcctcaatgaattcagctctgagttttccagctataagtgatgtctcccagcttcttaatcctcttaacattttatctttatactgtattttgtgatgtgggtcaatttttactttgtattgtaactatttacacatatttaatagtgtccttattagactagaagctccttttgaatgagacccattatcttatttatcttttatctctcacaaggcttattaaattacctgcagataaatgcggtatttagtataaggtatttattttattcaacagaaaccataataccaaatactgcatttatagaaacttaattatttatactattagcatatattcaactacagatttagaggggagcttctcacaaaaatgaaataaatgatctaatactataaataacaaaattttaagatatttctttaaaaaattataaactggcctaaaactaacttaataaaatgaaataagtagaggagtctgcaacatggtttagggacggtaacatgtttaatcaacggcaatatcaacacactgtgacatgttaatgttcacaaaggtcaccgagacctggaaaaaagtttttttttttttcattcatttgactacagctgatatctagttaatgattagactaggagggcagattatgccctgtattgaatggaaactttaagacaaaaatccactgaaaaaaacatagagctttccagaatgtattagatacgcattatttacacttaaatcccaatgcactcagtgcctttttctgaacaagctcctctctgaccatttattaacatgcaaactttaatttgtttttccatgaacttaacatacttgatatcttctaagaaataaaccatttggtcctatacaagcatttattgaatcaaatgaatcacaataagataaaggctaaaagcagttacctacttttgatcaagatggctacctttaaaaagtctactttcacggaaaaaaatattcaagtgtaccataaaggcaatttaaactagagattggtataattgcaggaataattggggtacagagtaaagttatcttaaaataaaaaaaagtgaagtattgttctgctttcctacaaaatagcataagaatatgctagattagattttgagtttgacacacaacgaatatacaaatgcttactttcaagtgtctgccagacatctctacctgaatatcccatagtcacttcaaaatcaacatttttgaaacctaacatcatcatgtccctccaacttgcttatctatctgtactctttaattagttattaataatagaatagctcttcacttatgtgctcaagccagaaacatgggagtcatctctctttctctttctctttctctctctctccatagacaagcaaccatttagtactgtatattttatcttccaaatatctcttaaattctctcatttccagcactattgtcaatgccaatattaatatcttaagtcaggcctttaagttctcttgcttagattgttacaacagctttctcaatctggtttccttgcctgagcccactctttctaaccaccagacttctggcagactaatttttccaaaaaacaagtctgatgtcacctcttgttaaatattcttcaatggataaacgtatttacaaggcacatcagggccttcatggtttggccccgtttattcttcattcattcattctgttcattcatcaagtatttactgaatatctagtatgtgccaatcactgttctaggtgtcagaaatataacagtagacaaatagacaaaaatgtcatcctgtcattgcctacttcctttcaacccttcttccccactactaccaaactttgtcttcaagaaatagtgaaccacttgcaatcagtgaagacgtctttttctttatacaaatttctactcactcttcaatatcaatccaaatgcaactgcctctcttaagatctccccgaatgtttgcaagtctatctttgcaagtccactagccagtaagttccttgagaatagaggtaatatcttttgacatatggttggcaaatgcaatgtctttttaaaaataaaacatgaatgaaatgacaaagtttttctaaattgttaattgtttctagtgatcaaataacctttttctcaatcttccagaagtataggcaaagtagtaaataagagtttgcaaaagcagctgttactgtccagtattacacaagagatgaccttcagagccctatatgaatgtaagcctccgaggtgttttgtcatctttccatttgaaatttattttggcatcagtttacttcataagtttgccttttaacctgaggcacattcccacaattaaaatgcaaaatagtaaatacagttgtccctgagcatgggatggggcttggctccaggaccttcccaccataccgaagtcttcagatgctcaagtcctttccataaaatggcacagtatttgcatatgcacgtcctcccagatactttaaggttacttataatacctaatacaatgtaaatgctatgtaaataattgttgttttatactgttttcttaaattttcattttttattgttgtactgttatttttaattggtttttaaaaaatattttcaacctgcattgcttgaatctgcagatgtggaactcacagataaggaaagctgactgtaaattttaagatacaccgtagagctagtcctcaaataatgtagtttcagtacaacattgttgaagacaaatgattcccagtggaagctactatctgtgtggagtttgcatgttctccccatgtcggtctaggttttctctgggtactctggtttcctctcacatccaaaagatgtgcatgtcaggctaactggcaagttgagatcatcccaggatgattgagtgtggcggggtgtgtgaatgcaccctatgatggaatggtgtcctgtccagggttggttctgccttgcaccttgagctgctgggacaggctccaaccacccatgaccctaaactggaataactaggtaaataattttcttacttgttattaatttttcttacatatatgtatagttcacatttatttcaatgtttattattagaagtgtttttggtctttttttgatagtttggtgatgtttctatgaccagaaatatgcatatgaacttgaactcttgtttatatccattagcctacggtaaaattggttttgttgtaccttgttttgcttaaagtcgcagtttccaagaacctacgatgatgaggaggacttactgtgtagcagcaacgacagattttatggaaaaggatattatccaatacagaatttctttatctaagacagtctaaaatgatgcaccttgtactctaacctaccgtgaatacattaaaaagtctcaaatcaggccaggcacggtggctcacacctgtaattccagcactttgggaggctgagtcgggtggatcacaaggtcaggagttcaagaccagcctggccaagatggtgaaatcccgtctctactaaaaatacaaaaaaatattagccgggcgtggtggcgggtgcccgtaatcccagctacttgggaggctgaggcagagaattgcttgaacacgggaggcggaggttgtagtggcaaaaaagcctcaaatcaatgtgcaattgtctacatataaaggcatccctgataacattttaagaactatactgagattcacgcattcactaagcatactgctttttgagataaaatgctacctgatttctctattcatttattaagcacatgtcaaaatataaatcaggaaaaacatttgaaatgtgtttcaaaagcaaaactgaaaagttcagatactgtacaccaactccttccaattaaacaggttggaacaccaatggtgatgtgagggggtggacatccgtcagtacataaagaactttgtgtttgcacacaaagacattgctcaacccacatctggctcctgcagccaaaatctaccctcactggggtgactcccactgaaatatatgggcataaagaatagggaaatgaattttttaaaagccaattgttagttccatagactttcaatatatgagggaatcaggatagaattgaatccacttttctactctcattttttaaaagagaacagagaggtcacaacagaagagaatttggtgttaggatatcagatttcttatgtcattgtataatcaggaaattcactggaattttcatgtttttttttttctcctgataggtcttctcatctctctgccactctaaatcataacctgtaagacctccacctcctatggaaagcctttcctattacactttaatttacttactcctgttctttttctactctgaactactatacttacaaattaagcagatattcataaactattttgtattgtatgtgtttcatagttttgcacagattagattataaatttcttgacaagagcaaaagcaatattccaaagtgcctaataaaaaggaagggcaatataacagatattgcaattggtatttgttcatcaaagggctggtcctttcatgctctaatttctactacgccaaaactaggattagtccttacaaagaagagttattatttacataacatgagctacatcacaccagggtcagtgtctgattaccaaaagacaactagaagaaatttttagaaaatatcaagaagtctgcaccacagcattgaatttcttacaatactcactctctttgctcaatatctgagattttgagaaaggctgtaccagcatagtggataggagtatatactctagatccagactgcaaatgttttaattccaactcttttacttactggcagttatgcagcaaattaggcaaattacctaacttgcattttttttcctgtacaaatgagaataataataatagtgtctacattatatggttgctatgaaaattacataaattaataactgcaaagggcttaggataatgcctagcaagtattcagtttaagctattattattctaaaatatatagcattcaattttaaaaggtataataggattttttttttttttttgagacagagtcttgctctgtggcccaggctggagtgcaatggcatgatctcggcacactgcaacctccgcctccccggttcaagcgattctcctgtctcagcctcctgtgtagctgggattacaggcacccgccagcatgcccggctaatttttgtatttttagtagagatggggtttcaccatgttggtcaggctggtctcgaactcctgacctcatgatccacccacctcggcctcccaaagtgctgggattacaggcatgagccatcgcgcctggcctgtataataggtttttaaataaaaattgaagacaataagagaatttcttctgtttataatgaacaacttcttccctagcataccaacaaaaaacaaataccccaaaatctactcatactcaagggtggttgatttaatcctcctttttggtataacactaattctattcctcagttaaaacaaacaaacaagcacacacacacacacacacacacacacacacacacacacaaaaaaaaaaaaaaaaaaaacaggtcaggcatggtggctcctgcctgcaatcccagaactttgggaggccaaggcagatggatcacttgagcccaggagttgaagaccaacctgggcaacatggtaaaaccctgtctctacaaaaaataggcaggcgtggtggtgcatgcctgtggtcccagctacttgggaggctgaggtgggaggatccattgagcccaggaggttgaggctgcagcgagccatgattgagccacattgcactccaggctgggtgacagagcgagatcttgtcttaaaaaaaaaaaaaaaaaaaaaaaaacagaaacaaaaccaaaaaaccaaaaagagattcaactagtagagagttattgagctgaatctacgtgccagtctaagtggacacaggcacacacacacacacacacacacgtatgtgcacaatttagttttcttcttttaaactttttttaatttttaatttttatggatatataatagtcatatatatttataggggacatgtggtttttatataagcatacaatgggtaatgacctttgtgttggaaacattccaaatctactcttctagctttttgaaatatacaaaatatattgttaactatagtcaccttattgtgttaccaagcactagatctttattcttctatctaactgtatttttgtactaattatcagaaaaatccttcatgttagatatattaatcctattttacagataaaagcaatgaggttcagagaggtcaaacagcttaataaaggtcacatagttagccagtggctgaaccaagaacagaatccaagtctaccaatttcaaattccgctccctttctactacacgtcatcacactacttgtctacaatttcctttctcccttaacccactcacatataatttctagcagagcagaacacagagctgtttgctcagagttcatccacatcttcttgcaaagtacacagtcctgcaactttccatttctgttctagtttcatgtcaatttaacttcctactaagaaattcagtgcttagggctatgtggatttagagctcctaagccttccttataaagacttcctttaagtacaggcttttaaactacttctgtgatacactacttgttctgacaaattgcctgacattctgaaataatattttatttattttatttatttttttttttgagacagggtctcactctgttgcccaggctggagtgtaatagtgctatgtcagctcactgcaacttccacctcccaggttcaagcaattctcccacctcagcctcccaagcagctgggattacaggcgcatgccaccacatccagctaatttttgtatttttagtagagacagggtttcaccatgttggctaggctggtcttgaactcctgacctcaggtgatccacccacctcagcttcccaaagtgctgggattacaggcgtgggccaccgcgcccggcctttattttttaataatattttttaaaactaaaaaaatgactctgttgtgaccaatagaagtataaatttatctcagaagtttaatatgccaaagacaaacaagaaatacagcaagtaaagaaacaaagactggaaggagcatggaggaaaacttactggaagagaggtcaagaaactgagaggctgaagtattgttaggctcatctatagatactgcaatcatctaaaattatggcaagtgtagtgccagagataacagtgagccaagtgtaagaaataaaggctggtgcccaggagtagaaacagcaacaaggaggtgtgacagcatagtctgctgccatgagcttcaaaggagtttttaggacggaggctgggaagaacactctgagagcagcaatgaagagtaagagagatatctattgcaactccaggtccagaagtaagagtgtgagacagaaaacaaccattacctgcatgagctgcaggggaaggaagatccttccagatttcacttagaagaagatgataaaggattttagaaatcaacacactttgatgctatgaggataatataaaaccatgtgttacctcattaaaaaaaggaaaactactaaggataacagaagctatcaggtaggcacacatagaaaatagtccatatagaacagggaaaaataatacagtcaggtgcaacatgatgacatttccgtcaatgacgtatggaatatatcatgatggtcccttaagattataatgaagctgaaaaattccgatcacctagtgagatcatagctgtggtaacacactgcaacatattactcatgtgttcatggtgatgttggtgtaaacaaacctactgcactgccaatcatataaaagtatagcatgtacaattatacacagtacataatacttaataatgaaaataaatgacttactggttcatgtatttactatactacagtttttattgttatgttagagtgtacatctacgatttttaaaaagttaactagaacagcctcaggcagtttcttcatgaggtatcccaaaagaaagcactgttatcatggatgacagctccatgcatgttattcccccgaagaccttctagtgggatgaaatgtggaggtggaagacagtactattggtcctgactttgtgtaggcctaggctaatgtgtatatttacgtcgtagtttttaacacaaaagtttaataagtaaaaaataaaattttaaaatagaaaaaagcttatagaataaggatataaaaaagaaaatatttttgtacaactgtacaatggacttatgtttaagctaagtgttatcaaaaagagtcaaaaagtttaaaacatcagagatcataatgttaaaaagctagagtaagctaagattaatttactattgaagaaaactttttaaaaataaatttagtgtagcctaagtgtgcagactttataaattctacagtagtgtacaataatatcctaggctttcactttcactcatgactcaatcactgactcacccagaccaaccatcagtcctgcaaactccattcatagtaagtaccctagacaggtgtgccgtttttatcttttatacgtttgctgtatcttttctatgtttagatacaaaaatatttaccattgtactaaaattgcctacagtattcagttcagaaacatgctgtacaggtttgtagcctagaagcaacaggccatactatatagtctaggtatacagcaggctataccatctaggtttgtgtaagtacattctatgatgctgtgtgacaatgaaattgcctaataacacatttctcacaacatatctccaccattaagtaacgtagtaataatattataggtctcttccacctcttgcatgaatcgtccatcactgaatatcacatattccacatgagatactaacaaaaaacctatttatcaattttaaatgaaaaaaattacaattcatttcatgtcaaccccaaaaaactaaccaagttcctaaagtgtaactaaaacacagtaaagcacctatacaaaagtaacaaactccaatgttaggatataaaatgctgaaaacatcacttcctgagcaaaaaccattcctaaggttaacagtggctacaagtagtaacatgctacatatcctctttgttgatatttggtgcacctttcaaattgttgacatgtgattctgacagtctaccaattatatctggaatttaacacagacttctcacacattattttgtttaaaatgcagtatttggctgtatttctgggacataaatgtaaatatgtattttataatgatctgccaaaacacactgaattgagagataatgaattctaggacatttgggtgttaaataccaagaggctttctactaggaaaaacacgaactgtgaagtcatttggtggactctgcttacatattacatttgttcaaatggttgaatggcagctttagtatataaaattagtcaagttaactataccctttaaacatcaaaattctcagtcaaaatgggaaaataataatgttctcctcaagggagtttttgtaaaaattaaatgagatggctgggcacggtggctcacacctgtaatcccagcactttgggaggctaaggcaggcagatcacgaggtcaggagatccagaccatcctggctaacacggtgaaaccccacctctactaaaaatacaaaaaattagccaggcgtggtggcgggtgcctgtagtcccagctacttgggagcctcaggcaggagaatggcgtgaacccaggaggcagagcttgcagtgagccaagatcgtgccactgcactccagcctgagagacagagcgagactccgtctcaaaaaaaaaaaaaaaaaaaaagattaaatgagataatgcacatcaagtagttagtagagtgccctagcatatagcatatgctcaataatggttcccataattatttgtattatctgtctagcaattgcagcttagaagatttatgcatgcattatcctgcttcttaagacaaaacaactttatgcaggagagggacaggacatggattattatctccacttcacaaataaaaagacaaacacttaaaagaattcagccaggcatggtggctcatgcctataatcccagcactttgggaggccaacgcaggaggatcgcttgagcccaggagttcaagaccagcctgggtatacggtgcgactctgtctcaaaataaaataaaataatgaataaaataaaggttaaagtgaactgcctaaagttacatgattacctaaaaatacccaccatgattggatataaaccaccatataaaccaggcgtgggtaaactttttccaaaaaggccaaatagtaaatattttatgtttgcagcccatacagtctctatcacaactagtcaatgctgccactatagcacaaaagcagccatagacaatacataaataaatgcatggaactatgttccaataaaactttacaaaaacaggcagtggggtggattaggttcataggccatactctgcagacccctgccctaggcctttagattactagtctagtgtacttttccattactttatggttaccacctattttcaggatagggtttcagcattaaacttggtagcattaactgtcagagaaaagataaatcaggaataatttgcagtagaattatgaatacagtaagatagtacataaatatcagtattactgttttttcctcttttacagcttctattataaaactctctcttaatccttcctttatttctttctcttctaataaagcactgggcctagaagtaaacacttttctatttctccacaaatatgtttgcagaatattattccaaagaaagtagtggacactccatgagacaccagaatgaacaaacttaacaatggcttatcttttaaaacggtaagcaatgtgaaacttctgaatctaacttgtatgagcatgttttagggggagtggagggaacagcgttaagctaccactctattctcaatctcaaagaatagagtgattatcagttttctcattatagaatctacatgctacggtatgctatggtagtgaagacactggacttggaattgaagacctaatttggaattctttctctggcacttactatctttgtgacctagtaacctatatataaggagttgctgtgaaaattaagacaaataactattttaaaatattaagcatcagaagcattgattattgctgcatttgaaattataaacttcttaatgaagttctcttctactttttttttttttaagacagagtctccctctctcaccaggctggagtgcagtggcgcgatctcagctcactgcaacctccacctcccgggttcaaccgattctcctgcctcagcctcccgagtagctgggactacaggtgtgtgccaccacgcccagctaatttgtttgtatttttagtagagacggggtttcactgtgctggccaggctcatctagaactcctggcctcaagtgatccacccgccttggcctcccaaagtgctaggattacaggcgtgagccaccgcgcccagcctcttctacatttttaataaactacaatatgatacaatattccataacagtataatatcatttataaagcatttaaaatatttagtgctaaagtataaagcacttctttgtcaaggagctaaaagttcttaaaacatgttctctcatttcagtccataatattcctttgaaattaaaacaaaccagaatttattgagtgacatgtgctaggcattttatatatatcaactcatttaatcttcacaacaaccttgagaagaaacaagctcagtgaaaggaaattacttgcccaaggaacacagctcctaagtggcagcagatcttgggttatacccaggttacactgagtataacctgtcattatttttttcattatttaatactgtctcttcagttttttgacttggggtccacaaaaagccaagtgcctcacataaggtcaaagaataattactttcagtgcagtacaaggcaaatgcttagataacagtacattattccactagattaaattacctccaaataacataatagtttaaagataattcctgcttaatctacttttggtctcaaaaatgtactggtaaatagagtaaaaccagtctacttaccactagttaaataaattagggtacccccaggttaagctttagatgtccaaagaaacaaatgtagaattttgattagagagaaaaataaaccaaacaacaaatttcctcaaactccaatggtatattaataaacataagaacatttctaaacctcctagcaggtttcatgcctgaaagcccttccagaaagcagatttattcttcaataattttttcccatgaaatttacagaaattatcccagagaaaaattggcgactctagtgcttttgaagaactaaatcagtaaattagatgtttttaaatcctgacattaaatataacatataaagtaagagaataaaagtatataaaatattttgtaaatctatgaccctcatccccctttgtttaaaccagtatggtccttgagagtagcagccttttttttccccttgctaaaataaaataaacttcagttccaccctctgttgcttacctgttgcacggtatgctgagagctccatgtggactacagtcacatggctgacagagcccagaagtgtaatttaggtaaaagccctctttgcaggtttcacagtgaagcccctgataacctggccgacactcacactgccctgtggtctggttgcagcgattcacattcaggcttccaaccacagagcagttacatacatactctgcaaaggaaagaaggaaagagacattaccaactaagatttaatgccctcttaataaaatgaactctattttatttttcttaataaattttcatgacaactttgtaaggatagataaaattaactctagttcaaatttactttctatcccgtttagtttacttaaatcaggaaacatatagagtacataaattatgtagtgtgtgtgtgacagtgtgtgtgtgtgtgtgtgtgtgtgtgtgtgtattattagtttttctgaattagaagccaccaaaggcaggcttatctacatggcactaagggcacatgttggaaatgacaacatgttaaataataaataatcccactgtatagcagcaaaagcctaaggctcagatgattaactttggcaaccgattcaaggtcatactagattgtgccatagctagaatcataagctaatgtgttctgcccaggaagaaattaatgaagaatagaaactttaaagtaaggaaatgatgaacaataaaaccagaggagaaagtttacaggttcatcctgatctgtgagttgaatgtctttcccaaattaaaatatttggaaaataaacatttcttttaagtatatttcaaacagttctttgttgtttgtttgttggtttcacttttttcacttttcgaaagaaatactttaatttttaatttttgtgagtacataggtgtataaggtgtatatatttatggggtacctgaggtattctgacataggcatgcaatgtgtaataatcatatcaggataaacggtgtgtccatcaccttaagcatttatcctttgtgttacaaacaatccaattatactcctttagttattttaacatgtacaattaaattactgtccataaattactaaattattgaccacagtctatctgctgtgctatcaaatactaggtcttattcattctttctatttttttttgtacccattaaccatccccacttcctccccaccacacccctgtccactattcttcgcagtcagacagttctttggataaaaatattgagaagcccttagttttagccttctaatgcaaagactcatttaaaggtcagttaggattcattttttgctactgcctctattcattttatcaaaaggaaagtgttttcaacatagtttgacacagcagtaacagaggactttgtattaacatatgtatcctaggaataggtcccattccaaaatagctatgatcctacccttaaagggtcctgagaaatctatggtacaaattacagttctaaataggtaaggcactatataaaatggcactgtaccaacacagtttagcttggaaaaaataatctttgatactatttttgatgacttcaaaaagctactagacaactacaaatccagactcttaaaaagagagttgtaaaggggtttgcttctccattctagaaaaggaaattaagcttcaaaattctttatgtaatcacaagcagcttatttatccacacaagtcaaaacaaaagattcctcaaagaaattcccacttggccaactctatacctcccacacttctgcagttcctaacctttggtgtcactttatttccctgctcttcacagctcttctagtttgtaaagataacaaataacaaataaatagaccaggcagtggctcatgcctgtaatcctagcactttaggaggccaaggtgggcagatcacttgagctcaggagtttgagaccagcctgggcaacatagtgaaaccacgtctctaccaaaaaaaatacaaaaattaggcgggcatcctggcatgggcctgtagtcctcgctactcgggaggctgaggtgggaggatcgcttgagcctgggaggctgaggttacagtgagccaagatcttgccactgcacccccacctgggtgacagagtgagacctgtctcataaaaaataattaacgtaaaataaataaataaatattggcagcttatttgtttattttatgtctatttcaaacttgggtggttcacaaaacccaaaggaaaattcacatttcttcagcctcaagcttaggaaaggaaccagcttcccattacaatcaagattcttattttcactaggctacataaacatgacatttctttgacagagttacatgttttcacatgatagctactttctgcgtatgtgtgttgtggtttttgtaaataacaaagccacgttcagtggtctgtaaacctgccaatgacaacttcataacaagaccttcactccaccagaaatgaccagaacacttaacatttttcttctgaaatcgggcagaaattcaaattacatccaacttctcctgctggacctattttatcaccagttaactaatcaaagtatgttggtgtcagtagaactagctcaagaaaaaatgaaaatactaaaaaaaattttctacaataaaaactatgaattttatttcattatttccttactaatgtatttccatctgaaaactgagtcaatgttcccaatgagtaagattagcagtatcttcaaaagaatccaattgaatttaagaactcagatataaacacttaatattttttccagtgaagttctaatggataaactttcaatactaaccaagttcactggttatttattatttctatagtcagtctaatatcttcattattccctgaacatactccggttagtcctgtctctgaacctttgcttattctgtacatcttggaatgctctttttcacatattcaaacctattctctattttaagaatcagctgaaactcacttctccataaactctaactgtactgcccctattatgaatccataacaatatctactacctaaacctctcaaatgacaataatttgaagagacagtaaagcaaagagttatgaagttatgagcacagattgtagacgtagacggctaagattaaatccggctctctcactaactttataaccttaggcaagttaattaagctctgcgtgcctttattttttctcctgtaaacagggcataataatagtagctataccactcagtcccaatacttaagctggaagtgctttggagtattgcaataattaatacaacagctggaaaaaagtagaaagtggtatcagataaaataataaatgcaattcagatgttagattcacaggctatagcttcgttatatcctgcggataagatctaaaagcctgaaaatgggtttagtactatagcagctttgaataacgtctgggaaacagaattagtgggctgttacgcagaaatccatgttgtggttcatctaggtagagaataagacgatattctacttataccaggctccactcattaacaatatgtgtgccttaaaatacattggtaaaaacagaaggatttaggatgtggcttcagagaagatgaaaaatgagcatttattaattatatatccttggtactaatcagtttatctgtagcagggtgaatggcaaatgtttcagcaagagagaccaccccagggataagaagggggctgacacatcaagacagaaaggcactatcatgttaatacttctgccccaaaaaaccaaaggaaaggaagagaatacaaagtaaaccaagtgccagggagcatgggcatcttttctgtgtgtaactcagaacttaaggcccgtcccagtgactgaccttaaatgaaatgatgcaagttaaatgaatagtataagcaacagtaataaatgtaaaacactctgggtattcactaaattgtgccaggataatttgttagcttgtaagtaaagtaaaatctcagacccttcacaggtctagacatttgtgcggaaccagataggagttaatgcagaaataatgcaatccccttagtaaaaaggtggcaatatgaaaaagaaggaaggaagtttcaattgatagaagcaatgagaaggaccaaagacaagaggaagtgctgactttttaatgagttagaatcttagacaccagagcagcacaaaggagtctgcaacatgattaatggcaagtcaccagtgtggatgttaatgggaatgaaacaatatgaagaggacacctaaagctaattgcagacaagtatgaataagatgccgaacagctcattcaattgcctaaaagtaaatatggaataaactctttatcgtgtgagtagcaggtttcctttcagccctttaattctttggaaaactctatagagaaataattagagaagggtaatgtaaatgttctcacagagagcaaaatcttggcaacattatttccttttatcgcctggcttctgaagaacaataaaatatagtgattttcaccctgaagaagaataagaaactaaaatctttgccaaactgctttaagtatttgaagatagtcacataaagtcccagagaaaatcaaatcctgcactttttcaaacattccaaaagccaagagatgaaaattttttagccctaaaaaaaagattttgtttacaagtcccataagttcccctgccacctacccccacctgccctccctttgtgcacaaacatttgctctggtaagagattatttacttgaacatactgaagaccttttctaggcctttaatatacctggtaggctctctcttcattcaatttttaaccatctatctcatagagaatatttggtatgttctggtattcagcttgtttgcattaatgatgggagtttttggaaaatactaattgtgattgtatgtcctaatgaatgtgtcctctctgtgtctctttttgaagtcatttctgagtgctaaaattatctgtaatgctcaagcagtttggaacaattgtgtgttaaccctttgcagataaaaaaccataaaaacagtaaatgaaaaatttgcgtaacaaaataaaataactatgtcctcagtcatgatggaaatctcctagaacaaagaaatgttaccctgacaacaatactgctggtaaactaaaatgattacaaaattattgcatttaagcatagatactagaagactacttgtggctataattaatacagagcactcacaggaatctggttcagaaagactgcctgaaattctatctacaaaattatcgcacttaagcatagattactagaagactactggtggctataactaatacagagcactcaccggaatctggttcaggaagacagcctgaaattcaatctacagccttttgcaaaactgcataaatacctttgcaaaactcaatttctgagtccttttcattcattcaacaacaatttcactcttattgttagttgatgcacaataataatacctatttatgcaatgcggagtgatatttcaatacatgcatacaatgtgtaatgatcagattaaatagcacatccattacctcaaacattgatcatttcattgtactatgaacattcaaaattctctcttctagctttttgaaaatatagagtaaattacagttaactatatttaccctattgtgctacagaacatcagtactcatttagtactatccagctataattttatatccattaaccaatctcctcccatccttccttctcacctacccttcatggcttctaatacctccaattctactcttttttttttttgagatggagtctcactctgtagcctaggctggagtgtggtgacacaatcttggctcactgcaacctctgcctcccaggttcaagcgattctcctgcctcagcctcctaagtagctgggattacaggggcacaccaccacacctggctaattttgtatttttagtagagatggtgtttcaccatgttgttaaggctagtcttgaactcctgacctcgtaatccgcctgcctcagcctcccaaagtgctgggattacaggggtgagccaccacgcccagctccaattctactccttactttcatgagctcgaattttttttatctcccacatatgagtaagaacatgcagtatttatctttctgtgccttattttacttaacataacctccagcttcatccatgtttccacaaatagcaggatttcattatttttcatggctgtatagtaccaatattctaaagcagttcccctgtgttttcttctagcagttttatagtttcagatctcacttttaagtctttaatccattttgagttaatttttttaaaagatgaaagataggaagtctagttttattcttctgcatatagatatccatttttcccagcatcatttattgaagaatatatcctttcccccaatgtgtgttctgggcacctttattgaaaatcaattggctgtaaatacatggatttatttctggattctctgttctgttccactgacttatgtgtctgtttttatacctatgccatgttgttttggttactatagttttgtagtatattttgaagtcaggtagtgtgatgcctccagctttgttctttttgttcaggattgctttgtctgctgtgattccatatgaattttagggttttttttaaaatttctgtgaagaatatcattgatattttgatagggattgcattaaatctataaattgctttaggtagtacacttgctttttaatatcttcaaatactgttatctattaagaatacaaaaaacctgtattaagttattcctaaatttataatatttatcagagcactggccattcaagttctaagtccaaaagatatatcatagttttagacagttggaactacagtctgacttgcaaaagtagatggaaatagttctattctcagcacacacaatgcaaatattataggaacatccactcagtggaagtcaaaagcaaaactgtactttgaaaggcaatgagtatccctctatttgaatggctaaaatacacaaacaaaaaaactgacaatactaattgctggcaagcatgcaggactttcaaaaattactggtgttaagtacaaaatagtagagacactttggaaaacagtttgacagtttcttataaagttaattatacctttactatatgacccagcaattccactcctaggtatttatctgagggaaatgaaaagttatagtcacacaaaaacttgtacagaaatatttatgataagtgatattaataatcaccaaaacctggaaatcacccaaatgtccttcaactagtgaatggatacactatggtacattctcataatggaacaccattcatcaataaaaaggaataaaccactgacatccaagaacatggatgaatcttaaatgcattatgctaaatgaaaggagccaggggaagagaacagatcaggggtttgccaggagctgggggcaggagggaagggctgactacaaaggagcaatacaggggaattttgagggggtaataaaaccattttacatcttgattatacatgtatcaacactgacagaactattgcacatcaaatgagtaaatttcattggatataaattttaaaatatgcaaaaaaatttttttaagcaatgaggtcttactagattcaatttttaaaattttgctggaaggatgccttggtgtcccacaagcaactatttcaactgaacttggcactaacgtccacaggggacccaactaatgattgaggctttttcaaagtgactgttacatttaagatagcaggaagttattaatgcttcagctgattattgcataaggagttgtggaacattttagtatttaaaatgctattttactaaaaggagtacaatcttttcttttccctttggctccaacttaagtcttaggctgcaactgctcccatgtacaatgagggagaagaggaaaaaaatgaaagataaagatgtataggattactatccttttttcatatgcaattgtttgtttctttttcagattgatcattaaaaaccctactctgtttaaacaaagaccaggaaaatgcatgtaaatataactttcaatctatctaatctatccaacaaagaacttcacccattttcacaagcctaggattggatccacaaaaattacatcattcctgatttctgaattgaaaaggaaaaatattgtcaaaatcaagagtaggaatacacaattcaaacctcttcatgtacatcgaatgagtctttaaaaaaaccaacaaactggctgggtgtggtggctcacacctgtaatcccagcactttgggaggccaaggtgggcagatcaccggaggtcaggagttcaagaccagcctggccaatatggcaaaaccccgtctctactaaaatacaaaaattagtcaggcatggtggcatgtgcctgtaatcccatctactccggaggctgaggcaggagaatcgcttaaacctgggaggcagaggttgcagtgagacgagatcgtgccactgcactccagcctgggtgacagagcaagaccctgtctcaaaataaacaaacaaacaaaaaaaccaacaaaactatattatcttgactacaggcctgatttcctaagtatatggtgtatttcaaaatgtactttttattggaccatattttatgttttaggtctgaagaaaaggaatctcagaaaagcctcattgtagggaaaaggaattatcaacacaagagtttttgttttgagagtcttactctagagtaacattaatactcaatttacatttcacatttatgttatgccaaggtattgccacaaatctttgaaaacttgggaaacttaatattaaagctgatgaatttctttaaactagactttgtagagatgtgtagtattaaagccactacttttaaagaaaagctttaagttttgtttgaaaataaaaatgtatcaattaaaattcccagtcacaatttactagagcaaaacatttcttcaactttagggtagccatatgaaataaatggggcaacataacccaggttttgtagaaaattttctgtctcacatttaaaaatcatgttgttagtgcttgtccctggctcactgccagttttccacaattcagagataattcatctaattaatgagacaagatgacaagttctggaaaaggttgtaaaggctagtttttactactaataacaatgatgatattaccagctattaagcatatactatacatatatcagacatcacacaagaaactggacacaaatggcctcctttagtgttcaccataatcctgtgatgcaggtaccttaagcaaggaatctgagtatcagatagatgaaacaaatcatacaactaatcagtaccaaagaagagactgaagcccaaaatgagtaactccaaagtccatgtcttttcactttaagaagccaacaatcagacagacccagaacactttaaaatcaaactttgctgctaattaaccagctctaggactgttagtgagtctaactgctctgagtttcagtgtctccatgtacaaaatgtggctaattcttttcatctatcatgaaaaataattaaaggtcaaattatatatggccatgtatattgtttttggtttacaaaaacttttttttaattgacccactggtatatctaataatctgaataagtaaatcagaaggcaatttcctttgaaaatttagaatgtatatactatgttttaagggaaaatcacaggttttaaattgctcaatgatggcaaattttctcatatttctccacatttctcatagtggcttagcacagtactgatcagtaaatagctataaatgtctgttcaaatcagattccattttataaaataaaattagagctggtcaatttaaaagacaaagatcttcaagattcaatgaaaacccacaaaatccagctacaaacagtttacaaaagacataaaacagaattatacctaaaggttaaaagtaactgaatggaaaaaagatgaagcacgtaaatactagccaaaagaaaactagtacagctagctacattaattaatatgagacaaaatagatgtttaggcaaaaaaaaaaagcaatataagcagataagaggtctggtcactacataaaaaaatgtacaattcattaaaaatatgtagttctaaattagatatatatctaataccatagtctcaaaatacataaggcaaaatgacagcaaatatatttaatatggttatttctgaggatgaaatgagataaaaatgtgacagtatcagaataggatatttactgttttatctccccagatgtcctacttttcttaaaatgtagaaaatgctctcagaaattgatatcagaaacgagatatgacaataaatgctctaaaataagggattggggaagattaggaattagagttggttaaactacagctttttacaattttctggcagaagggaccttcttttaatccagaattggaataattcaacaagtttcctgaagtcataaaaaaggtagaagaaagagagaagtctagtctagattatagaaaaatatttactatacaggatcatgtactcaaatactttactcattagcattctaaacacccttattctctaaatctcactctgtcacccaggctagagtgccatggcacactcccagctcactgcaacctccgcttcctggattcaagcgattctcctgtctcagcctcccgagtagctgggactacaggcatacaccactatgcctggctaatttttgtatttttagtagagaccgggtttcaccatgttggtcaggctggtctcaaactcctgacctcaaatgatctgcccacctcagcctcctaaagtgctgggattacaggcatgagccaccgtgcccggcctctaaaagttctttgtaccttccactatgtatcctctaccgtgttcctagagcattgttagagaaagttacaatataaagacctagtgtgttaaaggttttactttcactaagtccctagaactgcttctaaatccttagatttatcttactgtttcaatatccattgccagcattggctattccaagcttctctttaagtcttccatcccactgtacaaccagcaaatggttgcaacttcatggaaactgagaccttctttttctctcttcctgctttttcccatcaatttaaccttccctccagtttcaggctagccagctccttccaagaccaaacaatccctccaactgcgctctttatcacatcctctcccagagctctttccaggactctactctgcccactcccattgtccccctacttgagccttttcaagctttcactctttacagaatttaccttcaaatatgcattgggtctctcacaattctctgtttagtctcctgttccatttaactagcatttattttctaaataaaatttctcaaacaaaaatacagactgcctccttttcttcaccacgttttcttcttaatgctctgcaatcttttctaaactctactaaaaatgctctctcaaaagttactaacccaaaacaaaacaatagccttctcaggccatattctgcttaactattttgcagcatgtgacatactgataccccttcctctttgaaactctttctttggtctccacgtcattggataaatccatgagcatttactgaggattttactatgatcaagtcctctccttatgcttccacttccacatggcagatcattttggttcccaatgaatccagggagagacaagtctcagctactccagtcatccccatcaaggccccaaacatatgggtgaggccatttttagatcctccagctgtagccaatctaccaatacagccagagtaagcccaagagagaccaggagaagaaccatcagaatgagaaataaatcattgttattgttttcagacactaatatgaagaatgaaggagaagacatcactacggggaatattatgcataactctatgcacataaattcaacaactttgatgaaatggaccaatctcttggaaaccaagctatcaaaacctaattcagattaccttaatggtcctatacctattaaagaaatagaatttatagtttaaaaccttccaaaagagaaatctccaggcccagatggcgtcactggagaattctactaagcattttaataagaaataacatcaattctataaaatgtcttccagataacagaagaggtacgaatcctttccaattaattctataaggacagcattattttgacatcaaaaccagataaaaacattacaagaaaactacagaacaatattccttgtgaacatcttggatcaaaaacctctcaacaaaataaccagtaatatataaacaacaaattgaacccagcaatatataaaaagattaagtgggatttattccagaaatactggtttgacacttgaaaactaatcagtgcaatccatcctgttagcagactaaagaaaaatgccatctcatctcaactgatgcaagaaaagattttaaaaaattaacatccattcatgggagaagtgcccagaaaactatgaatagaaggaaactttctcagcctaataaagggtatctatgaagaaactacatttaacattatacttcatagtgagagactaattactttctcccaagatcaggaacaaggcaagaatgtcctctcttgccactcctattcaaaatcatattagaagtcctagacagtggaataaggcaaggaaaagaaagaaatggtcttcagatcaaaaaagaaacaaaactgggccaggggtagtagctcgacacgtataaaatcccagctctttggaaggccaaggtgggaggattacatgaatccaggagttcaagaccagcctaggcaacatagtgagaccccatctctacagaaaaataaataaataaataaataaataaataaataaataaaaagccaggaatggtggcacatgcctgtagtctcggctattcctggggctgagatggaaggatcacttgagcccaggaggtcaaggcagtagtgagccatgatcacaccactctactccagcctgtgtaacagaatgagaccctgtctcaataaatacataaacaaataaatactgtctctattcacagataacatgaaagcttatgtagaaaaaaatgtttattacaaaaattcctagaactaataaatgacattaataaggttgcaagggctgggcccagtggctcatgcctgtaatcccagcactttgagaggccgaggcaggcggatcacctgaggtcaggagttcaagaccagcctgaccaacatggagaaaccttgtctctactaaaaatacaaaattagccgggtgtggtggtgcatgcctgtaatcccagctactcgggagactgaggcaggagaatcgcttgaatccaggaggcagaggttgcggtgaaccgagattgcgccattgcactccagcctgggcaacaagggcaaaactccgtctcaaaaaaataaaaaataaggttgcaagatacaaaattaacaaacaaaaatcaactgtatttctatgtgttatgaatgaacagatggaatttttaaaattttaataccacttagaatagctccaaaaatatgaaatacttacatacaaaattaacgtgtatgacctttatgctaaaaactacaaaacatgaaaaaagaaacaaaaagatctaaaaatatggaagacataatgcaaacaattagatctatagatttaataaatcccaatcaaaatcccagaaggattttttatagatattaacaaattgattctaaaatatatgtgaaaaagcaaagaaacctcaatagccaaataacaacaaagctggaggactcacaataattgatttcaagacttactataaagctatagtaatcaagacatggtgttattggtaaaaagaaaaaagaaaaaacctacacaaaagccaatggaatagagagcccagaaataaaccctcagaaatatctaacaaatttaatttttgacaagatgaaaaggcaattcaatggagaaaggatgcttttttttttttaaataaatggtgttggtacagttggacatccataaacaaaagattaaaacttgacataaaccacaccttgtataaaaattaactcaataggccgggcacggtggctcacgcctgcaatcccagcactttgggaggccgaggtgggtggatcacgaggtcaggagttcaagactagcctggccaagatggtgaagtctcgtctctactaaaaaaaatacaaaaaattagctgggcgcggtggcaggcacctggaatcccagctactggggaggctgagacgggagaatcacttgaactcagagggcggagcttgcagtgagccgagatcgtgccactgcactccagcctgggcaacagagtgagactccgtctcaaaaaaaaaaaaaaaaaaaattaactcaacatggatcatagccctaaatgtaaaatgtaaaactataacacttctagaagaaaacacagaagaaaatatgattgaccttgcattaggcaaagagcttacaaataaaacaccaaaagtaaaatccataaaagaaaaatgtataagttggactttattaaaatgaaatactttgttcttcaaaagactgctaagaaaataaaaacacagccatagactgggagaaaatacttgcaaatcacatttctgtcaaagcacttgcatcaagaatatataaagaaccctgaaaacccaacaataaggaaataatgcaatttaaaaatggagaaaagatctagaaactttaccaaagaagatatatgtacgacaaataagcacttgaaaaggtacccaatatctttcattaggaaaatacaaattaaaaccaaaatgacatactactacacatctaagagaatggcaaatttcaaaaaactgtcaataccaaataccacaatgctgaggaagtagaactctagtacaatgttgatgggaatgcttgaaaaataatttgacagtttctttctttcttctctctctcttttttttttgagacaggatctcactttgtcacctaggctggagtgcagtggcatgaccatagctcactgtaacctcaaacacctgagttcaagggactctcctgcctcagcctcctaagaagctagggctacaagcacacaccatcatgcttgcctaatttttaaattttgtgcagagacaggggtcttgctatgttggccaggctggtctcaaactcatggcctcaagtgatcctccctcttcagcctctcaaagtgctaggattacaggtgtgagctaccacatcaggccagcagtttctatttttttttttttttcgagacggagtcttgctctgtcacccaggctggagtgcagtggcgcgatctcggctcactgcaagctccgccttctggattcacgccattttcctgcctcagcttcccgagtagctgggaccacaggcaccagccatcatgtctggctaatttttataaagttaaatatatacctaccatatgacccaataactgctcccaggtatctacccaagagaaatgaaaactgagttcacacataagtgtaactgaatgtttatagcagctttattcataatcaccaaacattggaaataacccaaatgtccttcgactggtgaatggctaaaccatggtcctttttatattacatatgagaatatttttacacgtcagaatctatgtctgatctattaagtggacctagtctggctaggtgcagtgggtcatatctgtaatcccggcacttgggtggctgaggcaggaggatcccttgagcccaggagttcaatactagcctgggcaacatagtgaaaccccatctttataatataaaaaatttttaaaaattactccagcatggtggctcagacctgtggttccagctatacaggaggctaaagtgagaggatggcttaagcctgggaggtcaaggttgcagtgagttgtgatcatgccactgtactccagcctgggcaacagagtgagaccctgtctcaaaaaaaaattactggccaggcgcagtggctcatgcctgtaatcccagcactttgggaggccgaggggggtggatcacaaggtcaggagttcaagaccagcctggccaacatagtaaaaccctgtctctactaaaaatacaaaaaattagccgggtgtggtggcgggcgcctgtaatcccagctactctgaaggctgaggcaggagaatcgcttgaacctgggaggcggaagctgcagtgagccgagatcacgccattgcactccagcctggccgacagagcgagactccatctcaaaaaaaaaaaaaaaaaaaaaaacaacctattcttatatcagcacataaaaaagttttaataactgcagctttataatgtgcttcactaatgtattatccttctttacatttctttagttgttcatagttactaatgtttccacctaaactttattgccacattccctccaaaaatattcccattgtaatttccccagtaattccatttatcctaaaaattaatgcatcaataactggcagctttacaatattcaattttcagccaggcacagtggctctggcctgcattcccagcactttgggaggccaaggcagacagatcacttgagtccacaagttcagcctgggcaacatggcaaaaccggttccatctctacaaaaaaaacttcaattttcccatctatgagcactaacatgtgtctccacttattcagtcttcttttatatcagtgaaattttataacttaaaaaatatgtatatgagtttcatacatatcttgttatgatgacttttaaactttttatcattagtagtagtggtggcagtagtggttacaactgtgatttttttttccattgtatcttctaatcaatattagtaataatcattcaattagattttttgagatatccatacagacattttgatgaactctcttattgtttctaatggtattccccttgattttcttgagtaagatttctgtttttaagttacatgattatgagatcttccattaaaggtcatatcttatctggctaacaacagatataattctgggtttcctccacaacagcttgtgataaaatacagcaaactgtttcatacaactgcttatcttaatccctaggtaaaccttattactattataataaaaataattgtcatttactatgatctactaactatgtctcggactttgttgcacattttacttgcatgaatacttagctttacaacaaccttgcaactgtagagactgcaagtcccagtttattaagaggaaaactaaaacttagagaagctaagtgcttgcccaagaccagagttagcgggtaagtggttgagacaacattcacatccaggtttatcttacgtcaatacccttcctcatttcacttcacttcaccacttcttcctttaaaagaaggggaggagataaggagcaaaaagaagaagaaattctacctaatactattaaatgcagttgtgttttcttttcttttcgtgtgtgtgagtgtgtgtgtgtgtgtgtatgtgaccggatctccctcggtcgcccaggatggagtgcagtggcacgatcacagctcaccgcagcctcaacctccttgcctcaggttatcctcccacctcagcttcccaagtagttgggactacaggcgtgcaccaccatgccagcctaattaaaaaaaaaattttttttatagagatggggtatcatcatgttgcccaggctggtttcaaactcgtgctcaagcaatccgcccacctcagcccccaaagtgctggttcacaggccagagccactgcgtctggcattttttttccaatctgtttttctgtaagcaagtgaaatcaaatcaaatgattaccaaatggtgtggggtaggagggaagcagttgctcaagctacaaaataaattatcaattggcaacaccttgcatttgttttcagctggtacaccttaacatactgttcaaagccaaagacacaatcatgagttagtatttgtcatccatttattttattcaaatgcactctcataactaaaacaatacaagtatctctctaaaagaaatgtgctaatttgggatcaagagttctggatatggactatactaagctatcaaacttctatttgaacctaggcaaaacacttatctttttgtgccaccacttttccattagtatacatttttcaaagttttgaaaaaactaattttgccacttagtaagagttaattgttcatgtttcgagagtatattttattttttgtacccattaaccatccccacctcccttccatgcaacccccgactactcttcccagactctagtaaatatctttctattctctatctctatgagttcaattgttttaacttttaggtcccacaaataagtgagaacatgcaatatttaactttctgtgcctggcttatttcacttaacataattacctctagttgttgttgttgcaaatccatgttgttgcaaatgacaggatcttattctgttttatggatgaatagtactccattgtgtatatgcaccacatttactttatccattagtctgttgatggatacttgggttgcttccaaatcttggctattatgaacagttgctgcaacaaacatgggaatgcaaatattcctcgatatatggatttcctttgagtatatatccagcagtgagattgatggattgtattgtagctctaattttagtttactgaggaacctctaaacagttctccatagtggttgtactaatttaccctcccaccaacactatacaagatttccctttctccacatcctcaccagcatttattactgtctgacttgtgggggatttttttgtttgtttttctgagacagagtctcactgtgtcgcccagggtggaatgcagtagcatgatcttggctcactgcaacctctgcctcccgggttcaaggaattctcatgcctcagcctcctgaacagctgggataacaggtgtgcaccaccatacctggctaatttttttgtatttcagtagagatggggttttgccatgttggccatgctggtctcgaactcctggcctgaagtgatccacctgcctcggcctcccaaagtgctgggattacaggtgtgagccactgcattcagcctgactttgtatttttaaatagcctgtcttcatgttcactagttcttctgcttaatcaattctactattaagagactctggctgaacagacacatgaaaaaaggctcatcatcactggccatcagagaaatgcaaatcaaaaccacaatgagataccatctcacaccagttacaatggcgatcattaaaaagtcaggaaacaacaggtgctggagaggatgtggagaaataggaacacttttacactgttggtgggactgtaaactagttcaacgattttagaagacagtgtggcaattcctcaaggatctagaactagaaatatcatttgacccagccatctcattactgggtatataaccaaaggattataaatcatgctgctataaagacacatgcacacatttatttttgcggcactattcacaatagcaaagacttggaaccaacctaaatgtccatcaatgatagaatggattaagaaaatgtggcacatatacaccatggaatactatgcagccataaaaaatgatgagttcatgtcctttgtagggacacagatgaagctagaaaccatcattctgagcaaactatcacaaggacagaaaaccaaacaccgcatgttctcactcatatgtgggaattgaacaatgagaacacttggacacaggatggggaacatcacacaccggggcctgttgaggggtggggggagggggaagggattgcattaggagacatacttaatgtaaatgacgagttaatgggtgcaccacaccaacatggcacatgtatacatatgtgacaaacctgatcgttgtgcacatgtaccctagaacttaaagtataatttaaaaaaaaagagagagagacagagagactctggccagcgcagtggctcatgtctgtaatcccagcactatgggaggctgatgcaggcagatcacctgaggccaggagtttgagaccagcctggccaacatagtgaaaccccgtctctactaaaaatacaaaaattagccgggtgtggtggcaagcacttgtaatcccagctactcaggaggctgaggcaggagaatcacctgaacccaggaggcggaggttgcagtgagccaagattgtgccactgcactccagcctgggtgacagagtgagactccgtctcaaaaaaaaaaaaaaaaagagagagactctgatgcattcttcagcatgtcaattgcacttccaactctagaatttctgttatttttacttatttcaatttctgttaaacgtctctaatagaattctgacttccttctctgttttatcttgaatttgagtttcctcaaaacagctattttgaattctctgtttgaaagttcatatatttctgtttctccaggattggtccctggtgccttatttagttcatctgatgaggtcatgttttcctggatggtgttgatacgtgtagatattcactggtgtctaggcattgaagagttaggtatttattgtagtctccacagtctgggcttgtgtgtgcctctccttcttgggaaggctttccaggtattcgaagggacttgggccccaaatgcagtaacactggtttttgcagacttatacaggtaccgccttgttggtcctggataagatctggaattctgtggattaccaagcagaaactcttattctttacccttaccatctcccaaataaatgaagtctctctccctgtgctgagccacctgaaactgggggtgtggtaacgcatgcacccctgtggccaccaccactgggactgcactgggtcagacctgaagccaccacagcactggatctctcccaaggcccttcccttcagggcggcaagctcccctagaccctggatgtatccagagatgttgtctgggagccagggatagaagtaaaaagtcttagcagtttacctgatgttctattctactgtggctaagctggcactcgcgccacaatacaaagtccttctcactcttcccccctttccacaggcacaggagcctcttcctgtggccaccaccaccactggttctgccaggccactgtcgatgttcatttaaggcccaagggctcttccatcagcttgtggtgaatgctgccaggcctgggactctgttttccaggcagcaggctcccctgtggccaagggcaggtccagaaatgctgcctaagagcctaggcctaggctccctagagtcagggacctcaagagcccatttattgctctatcctaccatagatgagctggtacttaaggtgccaaagtcccctttacctttccctctgcttttctcaaacagaaggagtctttcaccatagccaccacagctgggaatgtgctgggtcgcctctgaagccagcacatctcagagcccacggccccacagtgtcctccctggctactgctgctggttattcagggcccaagggctctttagtcagtaggtgatgaatgccgccaggactgggtccttcccttgaaggcggcagattcccttttggcacagggtgtgtctagaaatgttgtctgggagctaggtcctggaatgggggcctcacagctctgcttgataccctatactactgtggctgagcttgtatccaagatgcaagacaaagtccgctttactctttgcatcctctccttaaacaaaaggaaggagtcacttttgttgctgcgagatgcactgcctggggttgggggagggatggcacaagacaagtttacttatatgtgcatttctttttataataaaaatgggttatgtgcctaatgaaaaaaaaaaagaatgcatttgactctatcaggccactatcaaatttagtatgtgtaatactaaaataattaaccaagtactgcctagaaggcttaagagtattctatcctaattaccatatacctattaatatagagtagctgttatgttggtaactattcttcaatttatatgggctttttgatttacagcattatcacaatatcccaagtccaaggggaggcagggacagggagagcaaacacggaaactgaatttgaataacttgaaatccagctccaggccacagtagaggaagattagtttatgaagtaaagggacttgggtgcaaatctgaatccgttgtttatagctctgcaatctcaaatgtcatgtcctctttgtaaagacttttcttaaaattagagtaatgaaccttacaaggatgttttcagaattagaagatacaaggcaaaacaacaacaacaagcaacaacaacaaaaaacacctatgacagtggcctttctctaccctacatttttattataagcaatctgtttggcaaagtagcatccttagatgttactacagattgcaaaaattaaaaactaaaagggatcatcagaggcctattaatgaattcaaaatacccaaaataattcattaatgcctgattaaggcttaatcttataggtaatataacagaaagcataagaagaaaataacttcaatttcaagtactgccaattgcttctgaggttgggaccagatttgccttactgtccctgtttacagagaggccagatgagcaacttaaaggttagaactatttgctcattgtaatgcctggaaaattcattcagagaaaagtagtacaaagagaacaaaaggaaaggtcagtttaaaaatgctatcctaaggtgtgcagtggtataacctaggaactatttgccaatattcaaaaaagggaaggttggttccacattttgtagtttcacattcatccccaaccaattcttacacacacacacacacacgcacacacatatatttgaaacagggtcttctctgccacccaagctggagtgtagtggcatgattatggtccactgtagatcacccaggctcaggccatcctcctacctcagcgtcccgagtagctgggactacaggagcaagccaccatccccagctaatgtttttattttttgtagagacaggatcttgctatgttaaccaggctggtctcaaactcctgggcccaagtgatgctcccacctcagcttccaaagtgctgggattacagccatgagccaccgcacccagcccttacacatagtattaaatgaatattttgtagattactaggaataaatatatatttgcttacaaagttatgccatactatcttgggaaaatacatggggcatatggagaagagtgagtagagaaaatgtacttgttatggttgcagcaaagactaatagggaggaataggagaatatacatattagaaaggtatattagggccctgaactgcagtctaaagagtctgcatttcatccaacatggaatgattccccaaagaaggttctggtaccaccagcctcaaaatcacctggagagtacagtaacacactgattcctgggtcccatcctaggccgactgaatagaaatctctggtgggggtactaaggaatatgcatttttacatagttcaaaattcattctgatttacccaaaaagttggccataagccaaagggaacgaaatggtttggctgtgaacccacccaaatctcatctcaaattgtaatcctcataatctccatgtgttgagggagggaccagatgggaggtgattggatcacaggggcagtttccctcatgctcttctagtgatagtgagtgagttctcacaagatctgatggttttataaggcagttttccctgctcttgctagctctctttcctgccgccatgtgaagaaggtctttgcttctccttcggcttctgccatgattgtaagtttcctgaggcctccccaggcatgtggaactgtgagtcaattaaacctcatttctttataaattacccagtctcaagtagttctttatagcagtttgaaaactggcagtgtgaagcctgggcaacatggtaaaactctgtctctacttaaaatacaaaaaattagccaggtgtgggggcacacacctgcagtcccagctactcaggaggctgaggcagaaggatcatctaagcctgggaagttgaggctgcagtgagccatgatcatatcactgcactccaacatggacaacaggagtgagaccctgcttcaaaaaaaaaccccaaaacaaacaaaaaacttacaaggaaaaaaatttaaaaataaaataaaatccaggtataaatacaaataaaaatgtacaaggaacctataagatagttacaacctttaccatagagggtataaaataagaaaatagaggcacagagaaattaattttcccaaggtcagatggtcatgaccatctttaagagcagtgtgaagaaaggactagagaaggtagactagggctacaggtttattgacaaactgttgtagcaatttgacaggagaacctgaatttgggcagagtcactagtaaaggctgcttcttcaaacatacagatggcacagtaagtagggtctatctgtatattatacactgaaattaagtctgcttgctttctgaataaacactccaaggtcgaaaatatacctgtctgcagttgtctacagtgctagaagtttaatagatttgcagttttctagaagcaagtaaaatagctgagccttgagtcattccaaaggacattttaaaataactacttttttctttcagaagtcaaagggggttatcttactttgtgttccctatctaatcctcttaatcctcaaaacttgttgacaaattcttcccactctcctgccacacttcactattatcaaacacttatacagtataaacactgctccacactgcaagctgtgaaattctttgctttatcatcgtgactaagcatttgagtaacattttatattcaaaaagaagggcacagtagagaagaaatccctcttccaacaccactgatcattcctgctcttgcacacgccattagtggaactcagccacctccctgccaacacatatacgccatgtatacactaagatcctcaaaagaaaactgatgttgagaagtcacaatactaaaacagattggaggcttcatttttttttcttttttttttttgagacggagtctcgctctctctcccagtctggagtgcagtggcacgatctcggctcactgcaagctccacctcccagggttcacgccattctcctgcctcagcttcctgagtagttgggactacaggcgcccaccaccacgcccagctaattttttgtatttttagtagagacaggatttcaccgtgttagccaggatggtctcgatctcctgaccttgtgatccacccgcctgggcctcccaaagtgctgggattacaggcgtaagccaccacacccggccgggaggcttcattttttaaatgcgattttggaagcatcaagatgttgaagattttgttcaaggctgcaagcaatacagacataggattgcattccatgttcctgacatactcctaacctgctcatcacaatgtttacatcaacatcatactcttgcacactccttcagagaaaaatacaaaacacaaccgtcgaacttcctctaattattgccaaggcactattagatgttaacaatctcggatattctcagagaccaatggtcaataatatatcaaaaaagaaataatttggctccctcctcccctcctgaagtaatagtcttggagaaacaggcaatgttagataaaatatctaagggaaacagactatggctaaatgatatctatttccacactagcagaatttgccaattctttctacttcacttctgatttcatacatcccattcactactttctgtaccattaaaagctatcaccacagtcttggtggaagtgtaaaatggtacagccactatgaaaaacagtatcgcagtttcccaaaaaattaatttaccatatatgattcaacaatctcattaatgggtttatatccaaaagaactaaaagcaatgcctcgaagagatacttgcacaatcacattcatagcagcactattcacaatactcaagaggtggaagcaacccatatgtctattgatggataaagaaagaaaatgtggcatctatatacaatggaatattattcagccctaaaaatgaaggaaatcctgtcacatgctacaacatggagaaaccttgaggtcactgtgttaagtgaaataaactagtcacaaaacaacaaatactccatgattccacttatgaagtatctaaagtagtcaaattcacagaaacagattggaatgatagttgccaagagcttgggggaaggggaaaagggagttgagggaattttttttttttttttttttgagatggagtcttgctctgtcgcctaggctggagtgcagcagcgtgatctcggctcactgcaagctccgcctcccaggttcatgccattctccagcctcagcctctctgagcagctgggactacaggtgcccgccaccacgcctggataattttttgtatttttagtagagacggggtttcactgtggtctcaatctcctaacctcgtgatccgcctgcctcggcctcccgaagtgctgggattacaatcgtgagccaccaggcccggccgagggaattcttatttaatggatacagagtttcaaatttgcaagatgaaaaagttctggaaatctgtttcacaacaatgtgaatatacttaacaaactgtacacttaaaaatggttacagtggtcagctttatatgttttttaacccataatttgaaaaggagagagggagctatcatgatacagtatgctggtaggcattccttacttccctaactagaagctagtgaatcttaaagtgctggaagttagagatctgattatctgctctaccactacctcctttttacagataactgaagctaggagtagtacaccaatctttaaagtcaggtggactagaatccaaacactggctctaacactttgctgtgagcctcagctccctcccctgtacaaatgtggatattaaatgaaacaatatagcatagtacttggcacacagtcttccttccctttcaactctctgggatggttcattttgtagtcaaagccctgtcttggttggcaatggtaaacagagtaactatttgaacaaaaaggaaacaggtgaatttttaataaaatagtttgtgtgtgtgtgtgtgtatgtgtatatatatatatttagatcaattcctgagaaatgctgaaattaagccaactacccactgaagtgattctgctatatgttttaatgctttccctccaaaaaaaatatctaattttaaggagagaatggttacacataaaatttatagaatcatctaaaagaggctactcctagaacagccaaatctctcatacattcctggttgaaatataaacttgtataacctcttcagagaagaatgtgcatattctagaacctagcagtgccttgcaactccaaatatggtctatggatctgcattacctgggaacttgtgagaaatatagattctcaggcccacctgagaacaactgaatcaggacctgaatcagaacctgcagtatcataaggtactcaggtgattcctatgcacattaattgagacgtattgctctagagaaactcacctacaagtgaagaaaacatgtgcaatgttgttcattgcagcattacttgaaaaagcaaaaaatgtagaatcagctcaaatgattatcaataagaaaaatgagatattgtggactattcatacagtaggaaactatacagcaaacttgataaagcagaattacatggaacaatatagaaaaatctcaataaaatggtgagtttaaaaaaagcatggtaagagttcattatacaaaatttgaaacatgaacacaacactgtgtgtgtgtgtgtgtgtgtgtgtgtgtgtgtgtgtgtaaacatttttaaatgcatggcaccaaattcaggatagtggttacatctgggtagggaagaaagaaaaagagataaaaaaaaaaaaaaagaacaccaggaggctatgatcatatttaatattttatctcaaaaatgaaaacaatccaaagcaaatacaggagaaaattcagatattacaaagctgggaggcaggtatacaggggatgttcactatattactttttatacttttcagaaaacttatttcatattttttaaaatgaagaataagtttctccccattggttagcatttctcataaacaaatatcatcgtactcaaacttgtactatagaaataatcatctatttgtcctatctaggttttaaaagaacaagttttgcatctgacttatctctgaatgcatcatctcctctccgcaacacacacacacacacacacacacacacacacacacacacgcacgcacacacaacttctcttagggcttcagagatcaagttaggagatttgaaggtcagattcaagtgaagatatggttacctgggccaatcaacatggaaaaacagaatctctgcctggggtagccaagattatggacccaaataggactaactgtaaagtctgcaaaataaggaaggaaaagaaacagtagtgctaacagcagggctgtatcaggtgcaccaaaatcaagtgaaaaagaaaaagacatacatccaagggcatgaatatattcattcattcagcaaatatatattgcctcatatatacctgctaaacattatttcagatgctagggatgtggcagtaaacaaaacaggccaaaattaacgccctcatggaccttacatcttagaaatggacacacaattagttacttaaataggttaagtatttagtatgttagaaggtagttaaatcctaaggaggaaaaacagcaggaaagggagacaggggagatggaggtggagagtaactacatgtgtgttgtgggagtgcaattttagataggatggacataggaagcgtatggtaagtatatgcaggagtttttcattttacatgttctttacacgtgcttctgggcaaggtagagaggtttaaaaggttcaaagcaatgttctgttgataattgaattagtatgaatagaagatagaaaaatatgcagagcacaaaaccagagaactgtaattcttctctgaggtttctagagaaaagattcctggcaaagcacattaatcactggttcaatcatcaacaaactagtgttgtgccagaaatacagactacaatttctaggtgctggagatacaacaatgagaaagacagacgtggtcattgttcttatacagcttaatgtcttatagcagagagaaaaacaaagaagcaatatcgtgtgataagtattgaaacagaaatatgaatagaacattatggtacatgtgtttgcacatggagaaccacctaattcagactttctagaggaagaaatatctaagcatggacgtgaagaatgaggaggtatagctaagctaagggtagaggagaggagtatccccaaggcaaggagcagcatgtgtaacaacatcaaggcaaaagagagcatagtactatagagaactggaaaaagtgcattgtggctgggacacagaatggggtaagaagtggtgacaggtgaaggactttcctaagagcaactggatagccatggaagaattttatacaagagaggaagaataatcagatctacatcttagaaacataattctggctacagtgtgaaaatggaccagggaaagaatgaatgcaaagagactttttagcagcctgctaaaaaaaatccaattgagagatgaagatagccagaaaaataaatgccaagagcatgtgcatgttattatgaccacaggatatttatcattacctgtgcaccagatggtaggctcatatcctaaaaacctagtttttcccctattgtagtaaaaatgaatcatgtgtgccaatgaattatcattgtctcttactcagaaggtaggaaaattgtataaaaatcaaagaccctaataaattgggcccataaaaatgttgccagagttgtgctttataaccacctaaagtcattatgctcttctctaagacagcacctttacttgcacattatgtcaatacctgataacaattttcatcctctcccttcccataacaatttttctacccgttttaacagcttctgagactctaagattcatgactggctgtgtaagaggcaagtacttgcttttcagctgaataaacaaagacagacaatgagggtaatgtggcaaatgggtctgcccactcagatattttccaaagaaggagttcacgctgggctccctcagttggaaagcccaggggaataaacattccagatatataactaaactaatatcaaagtcatacttcatcaagcactattacttctgctgctgagggaatggcatacaaaactttggggaaattacgaggtccaaggacataaaaattaaagaatgggaataaagaaggtaagtacactggggtattttgttgacaaaaccaaacctgacatattaaaacaactttactcacccagagaccaagaaagcaatgaactttcatcaatgccctggagtcagtgtgtgtgtgtgtatatattaaaggatatgtggctatagtcaaagatggcaacattcaaaatgaaaactatttgtattttagggtatactctaaaagactaatgttttgtatcaatgatacatcagatgtagaatgtttggcaatgcttggggcagcttctctatcctttttatttatttcattcaaaatgagcagtacattcctaaccaggtctgctcagacacccagggtgctactgaatggtagtacagactcttcagtgaccaagcaaccaatatcctggaatttgaaaagaactttttataatgaaaagttccactatcaatagaccatttgcctgagttgttttcatagttgcaactgaccctctgctggagaccaaaatttcctctgtattatccctaaagtcactccactagctaaaaattaggataggacagaggaggagggaagtactttaaattctaacataacaaaagaagaaattaggtaatcaaaataaaaatgcccttgttataaaaataatgttggccacagacatttaaaaagaaatataaatattttattgaactcaataaatatgtatggaatgagcatggttccaatgacacattttagcacaagttgtttgcagttaatatgaccattgataagcatttctttgagtcatagtttcttcacatgtagaaactgggtaataatctgtatcctaccctatccaaacaattccaggagtatttatgttgccagttttcatcctcagttgagttactaggtatttaacaatgccagaaataacaacaaaaaaagccaccatttttcattacttgtctcaaaaaatgatcaatcaatcaatcaagtctctagatttagctctagcaacataaatggataggggtgtggatgaggcaggactggccatggagtgatagttggttgtgcaggtgggtgagagatatgagaaaggtcataaccctactctgttaattttggtatatattcaaaattttccacaatacaaaagtttttaagtatctttacgttactctcacaggcatattttcctagatacttttggggcatctttgccacaggccactgatgccctgaacaagaagtcagatttcaaatatgcacactaggcaaaagctcttcaccaagattaacttcaataaagttggatagtttaaacgcattttatcaaaatttcctgaatgtttggaaagtagatgaattgctattccaatgacaattttaagtaacatcaattgaattctttccctgtgctttcactgttttaagtgctttaccaacatcatctcataattctatgatgtaggctgacagacagggagtaagtgatggagctgggattggaatccagacaatctgacttcagagcctgcacttttaaccaacaatgactggatacttcaaggctgaacattaccggtttgggtagcattagaaagaattaagaaaagagaggaagaaaactacttcaggctcaaaagtacatatgcattgccttgtcaagagaagcagtataatatggtacggaataaattgagttaggtacttcgaatactgaattgtggctatgtaccactcattattacatgatcttgagtaagttaaatacttcttatcttcggtttcctcatccatatttaagtttaaggtaaggactgaaagtgaaaatgtacattaaggaatctaatacataagtattctagagcacttgcatttgtgtatgaatctgtctctccactagattgtgaatgcctaagtcattcaccattctctcttcagttcctagcacactgcctggcatacagaaggcacttgtgtttgtttaacctaacatcagatccatcaagaggtccagcaccaattggtagctttgtcaagtctctaattttaattatctaagtctatgtgttataccaacaagtaaaataggtttcaaatgtttgcttaataacagaagacaggaaactaattcataaaccctctattattatgttatctagcatttaatccaaaattaatgatggaaaagatttaaagagacagtaagtgccctctaattatcttctctgatgatcatttacacttatagaagtatgttgcagtttctagactgatctttccaaacacaaatctcaccatgtcacttcctggcttatacttcttcatggctcttagaatcaatttctgagcatgacatggaaagcacatcatgatttgacaactttggaccatcccagccacaaatctcttcattccctgttccaccttcatgtaccttttcctcccctactcgagccactcaggacttcagttccctaaatgggccatgtatgtgctctcttacttctgtactttttcaacaggctgctgctcccttttcctagagtgtccttcccctcttctacctgaataattcctatttgttctcaagactccactgagagaaaacatcccacagaaagcctttcctgacattgtccttcatcccctaaaagtctgggtaaggagtcctctctttgcttctgtagtacataccactatgatagaacttaccattctgtagtctaattttccatatccttcgctatgttctcaatgacagaaaccaggtcttatttgtctttccagtatctatctagcccagctaggtgcacagtgggtgattaacaaagatctgatgaatgtaaaagaaccttattttgtataacagaaagcccagtgtaaacttattgacaaaagcacacccttttctttgttacttaaataaaagtgaatgtaaagtcaaacagaagcatcttagtgaagcactgttaaagaccaatttgagcatggcaagaaaaaataaagaggatttgaaattttgtctggttaaccaaaaaaaaaaaaaaaaaaagaagaagaagaagaagaagaaaaaggaaaaagaggatgataccattgcagattggttaagcaataaggaaacagaaagcaacagcatcctgctgcttgtggctttagtccctgaagaccatttaatcacagattttaagtgtgtgtatttctaaatgagtgctctattacacaagatcatcaactaaaagaagtatagcaaagagaaatgcttacattctgataaactgttaaaaggcttgctattaacaagaaagaccatatgctaagaaaaataattctctaaaacagcaagtttaagtaaacatttttgttggcaataaatgtctggaatccatttggaatttttcagtattattcacaagttaaaaataattgatacatataaaagtacattactaggttgcaaagcatttgtagcaactcaataccattatttgctattgtctctatttctgaccaacttgtgtttcatgttttacactggctaaaatgactgttagtttggggatgtaggctattagcccttaaatgtcatcctggctaatgtataactttactcatctgactcataacagacatccaagtcttctcctctggaaaccaatccactgtacaaatcaattaggctaaaaaaaaaaaaataaaggtaaaagtaaaatggacagagcagtatgtgaggatgtactttttcttttgggtaaaatgcatactttctactccaaagaatcaggagaaaaactgaagagagtagtaaacagatatatgatatggacagtaaaataatgactacaaatcagaaaagagaagcaaaggtggcaggggcaaaagatgcattacaactaacagtggttagaaggatataatagaacacattaaactcaacctacatttagcatgtcattttgccatcctagaaagagcttaagaaataagatagatctgggtttgaatcccagctaactagcacttggctgtgacctttgggcaaacaacttaacctcatcttagattcaggttctttatttgtaaagttgggtaacactgcttatcaacagaattgagaggattagaggtaatgaagaatttaaaaggattggaagcagtgaagtaaaaagtccgaaggactaagttttcaatatgcaataaaaagtacagctaatatttagaaggccaatttatgccaggaattctaagtgttttacatttatacgaatcatttcataattatgggcctccacttcttcatttcttcaaagtgagattctactgccctaggttattctacttttttaaacataagtacaagacagtttgcccaacagccttttcttcccagagtagatgcaatctcatgatacagctggttatacacaaaaggaggccaaaaagaaagtttcatgtttagcaggtatggtaggtacttcaggcaatttttgtggctagtgactatcatggtaggtctaggaaaaaatttcaaattgcccttttctggttatgtttctagataggaagaagaggtaaccaaagatgaataaggcagtttctgtcctcactgtttgtggtctagttgtatattataatatggtgctttgaatttcccattcacattcaaaggcctttttgacagcatcactcccagagataatttactatttaggggtattcacttatttaacaaatatttaccacagacctaccacatgctaggaattaatctaggtgctggccatatagtggtttaaaaaaaaaaaaaaagagagagagagagagacaaagacaaaaacccctgcctcttatggaccttacattctagtgctggtggtgaatagggacaatttatgcaccaatgctgttcaatgatttatttagtatttactacatgctgaacactatcctatgtacatgttagggagtgccaacatcaataagacacagcctataggctacttgagaaaaggtaaagaggagtcagttacatagacaagtaatacttaaaataagggtccttaaaaagcaagtaatcaaaaggtcaggcgcggtagctcacgcctgtaatcccaacactttgggaagccaaggcaggcaaatcacaaggtcaggagttcaagagcagcctggccaaaatggtgaaaccccgtctctactaaaaatacaaaaaattagctgggagtggtggtgggtgcctgtaatccagctacttgggaggctaaggcaggagaatcgcttgaatctgggaggcggaggttgcagtgagcccagatcacaccactgcactccagcctgggtgacagtgtgagaccccatctcaaaaaaaaaaaaaaaaaaaaaaaaaagcaaataatcaaaaactatgtaatgttaggaagtataataggaggctgtaaggatgtttttaaaggacaaataagtttgcaggtagccaaagaaagggtgtgggtagacacgtgtcattctttttgtcagcctagtatcatagtataatttcccaccattctcagaatcccttcctatttggaggaattctccatattttaagccttgataccgcatcacgtaggttcataatgtcagattcttgtttttctggcctcccctgcagccagggcatgggccagtcattgaggttccaacaatcagatgcacctttacctggcttggaattagaaactaatgattcaaaggaatgaacaggaggccctctctctggtggcaaacagggagatggatggagtatgacaagtggcagtagcacttgttcttacatccaatacccaaggttagcagtgtgagtggtgatgtcagtggcatatattcaatggacacaactgactattacctctaactccgtggcctgaatttggtacctctggagattctgtgaactcctcaatatccttttaataaatttcaatcctgattgaatcaataaatgatttctgttgcttagaattaagacccctattgaaactgaagagtagggcatcccaggtagagggaacagcacatgcaaaataaggagaatctagttaacttagtgattaggagaggcagctctaaagctaaacagatctgaatttgaatcaaggttctacattgtactagctatgaaaccctgctttgtgtattcaaactctcaaaacctcaattcctgcttggtagagtggggataataatacaaactttttattaggttcttttgataattaaatgaggtcatggaaattcatttaacgctcttagtatctgacaaagagtaaccttcacagatgattgctttattaataatgataatgaaaataagcatagtatttgaaggaaaatataagccatttcagtctgctagagtttaaagcacaaggggaaaagtacaagaaatgaggatggcagacatcttggagttttaaatcataccaaagaacttgagctctatgggctgggctcactttaacagtgagtaataggagaattatagtgaaacataaatagtatattaaatgattaactaggcaaatatgatgaggttttactttatatatgtattctccacatctatagttgtatagtatgatctgaccactgtacttatgtacctgtaggatgtaatctagttggaaaacatattcgaatctagttggatctatagttgaataacagctgctcctttgtctgatctgagagataactaacctttgagtaaggagagaagtttacaaaataaggaaggggaatgcaccctgaaatgactggcagagtatgaatcacatttgcaagtctgatactctatgacctttctttctttttttggagacagggtctcgctctgtcgcccaggctggagtacagtgggatgagcttggctcactgcaacctctgcctcttgggcacaagcaatcctcccacctcagcttcccaagtagctgggaatacaggcacaagccattatacccagctagtttttgcattttttgtagagaaggactttcatcatgttgcccaggcgggtctcaaactcctgggctcaagtgatctggccctctcagcctcccaaagtgctgggattacaggcgtgagctaccgcgcccagtctattctatgacttttatataatcaaacgtcatctgctatttttttttttttttacaaaatattgttatgcattagcatcttggtctagagtccatattaagttaaagatgaaaggttttatagtcaagtcaaaaacaatcaatactaccatttcacagtatgtggtattacttgctaaatgctaataagcatgacattgtctcttgttagcaccgatcctctttgtgctgaatagacaatcacatagttactattcagttctgctttacatttgccatgcttttctacctgcttaccctcatttaatttccaccattatctcctctcccaacctccactccacacccatatctgccttcaagaaacactctttgatctaattttgattttcacagtagctactgaaagcgaacctggatcactgtgtacatctcagaaccagtgctgagacagaaaatgtatgagtttgctgggggaggataggggaggtgaaaaaaaaacagaacccaaaatgtgctctgtaactactaaatgctttatttcattttctgctactcccatctgctttggcaatgcagcacagtttaatcaaaggaaaaaaggggcacagatttgagtcagagggctagttttgaattccaggcccaacacccaagaaccctatttggtaggttactattatactcatgttacagaagatagtatagaagcccaggaagattatgtgacttgcacctgtatgcaactatgtaatgttagaaagtataagttataataggttataataggtgtatatcaatgtgctaccaacataaaatagagtggtcacatctttctacgagcccaattttatttttactttactaggtcatttgtagctagggcctacataagatcccaaggagtatatactcaccagaactggacaatggctgttttggggatttccatctttgcatttgcctttttaaaatgtcttctatttagtccagttctgagcagtaccattactgctgtaactggcaacatgacacaggataattctagcttgacctgggccattctggaaggataggaggtagcctttgcctcaagcatattgttactaacctgcaccttagaaccacctattagagagttgatctgtgacaatatgcaagtctttctgattaccaatgtgttaccagtctacagattatatgacggaagttggtaaattaattaatccagaattaacagacaaagttctcactgctgtctttgaaaaatccctgtttttcaaaaactgttttgagtgtttactatgtgctgattattaatgtatgtgctgactattaagcactgctgaattaagggttttacatgcattgatcaatttaatcccctctcaataacactatgattcattactgcttggatttcaaagttcaaaattcagagaagagtaatcattaccagtttcctaaaggccagagtcattctctggcatattctttagggtagcacctaggccttttggcaacgtacaagccaggcagatgggcaccttgtcttctctcatcacagtattgaaaaataccaaatgtctggctttgttccaggctgctttgggctttcaggggccacgtgaaccaaagacaaatcatgtttgtgctggatcagacacaagaaaaacagtcactgacttgattctgccagggagtaccaagtctcaagtaaagcatcatatggggtcttagatcaaaatagatttactttctttttggtgacatgataaataatttaaatgtggtgaattttttcacattttgatctgtcttatattggtcttcagaagactgttaaatcctacttgcacctctgttttcataacaagcaagtgatctcatttattatcatgagaaatgaagcaatatatgcagtaataaaatattaaactcaatcagtgattttaaaaaagctttatgggacagcttttttctctatttttcattttctacaatgtttattgtagaaaatgaacatagattatttttataattgtaaaaaaactggccaggtgcagtggctcacacctgtaatgccaacactttgtgaggctgcgataggaagattgtttgaagccaggagtatagtatcagcctgggcaatatagcgagactgcatgtctacaattttttttttttttaaattagctgagcatggtggcacatgcctgtagtcccaactactcaggaggctgatatgggaggatcacctgagcccaggagttcgaggctgcagtgagctacaatcacactactgcactctaacccgggtgaaagagtgagaccgtgtttcttaaaaaaaaaaaaaaaaaaaagtaagtagaacccattctaaacagatcaaccaaaaataatattacataaagcacaacttatatatgttgtgagtttaatatgagataaagattattttgttttctcaaggtagtggggaagaaaaataatactaaaggacctcaaacctttggaaaacaccataattgttaaattatacaaatatgtcaactacaaaatagcataaaaatatattttgtgtaaagaagccatatataaatgaatgtgtttatttctttgttgtgtttaatcaaagctatcttggtcacattccattataagctaatataaaccatgtaacttggaaagaatattaaagcctttatgtctgagaaagcccaaagtagtttacatgtgttacttctcaaaaacctttggtgactggaagtttcattttatagtctgggaaactgagtcatagagtcatcaaaaaatatactcaataactcaaaaagtgaatagaaagactagaatttagttcttctgacttcgattctactgattagctggaccatccagccctgcctttgcggacaagttgaagcaacaaactaacttaaaaactaaaaccagttgaacaggataggtttgcaggcaatacaccaacaattcagtataataatacccaacaactagattgctttgggtttttggtacactttataactattcaataactcacataacatcaatagatggtgggactataatgttagtgctattcatatagaactgataaaacacactgtaggattacaataaatataaaatcacatgaaaaatctacagcagaaaaagcccaatgccttcctctcatcaagactcaataaacaaacacaacaggataaatatattggaatgcaagtccttccccccccgttatttccaataacccttcccaatccctataatgattaataggacttaagagaatctaaaaatctattcaagttatccaatttccttcagagtgaataacatctacacttttcctagaatatttttaaagaaatttcatctttaaagaccgtttccaggccaggcacggtggctcacgcctgtaaactcaacacttgggaggctgaggtgggcagatggcttgagcccaggaattcgagaccagcctggacaacgtggtgaaaccctgtctctaccaaaaataataataataataataattaatttaaaaaattagtttaaaaaaaattagccgggcatggtggtgcacgcctgtagtcccagctacttgggaggctgaggtgagtggatcatttgaacccgggaggtcaaggctaccgtgagccacaatcacgccactgcactccaggctgggtgacagagtgtgaccctgtctcaaaaaaaagaaaaaaaaaaaacaatttccaaaattaaaaaggagtaggaaatatgatatcctccttgtagttaacaatgctactacttctcatctcttctttttgctcacatgtatcaagtaaaagcactagattattaaaaataaatgataaaaatctaataagatctgtgataatatgccagtttcttggaagcatgtaagactgaaataagttttcagactcagttatctaaagggtctaaaatttagtaaataaaggttatttaacattctccagccaggctgacaacattcctactccttatctttttccctatgactaggcagaatgtattcctttttccaaatgaataaattttcccttcccttaatgcttagctgtctccctggcaaggtatcatatagaacagctgttatattaccagtataacagcaatcccgtctgatctaattggaaaacatatggacagactgaaaccaaacttttggaggctcagtaactttaaagaagaaataatcaaatatattgataaagactatgaacaatgccatgaattcaaattttgcacaatctaaacaagatctatttcaataagctactttaagtaatgttcaagtgaatgctttaaattacctagacaaggtggggagcagtggctcacgcctgtaatcctagcactttgggaggccaaggcgggcggatcacgaggtcaggagatcgagaccatcctggctaatatgctgaaaccccgtctctactaaaaatacaaaaattagccaggtgtggtggccggcgcctgtagtcccagctacttgggaggctgaggcaggcgaatagcgtgaacccgggaggcggagcttgcagtgagccgagatcacgccactgctctccagcctaggcgacagagcaagactctgtctctaaaaaaaaaaataaaaaattaattaattaaaaaaattacctagacaaaatgaaatggagaaagagccagctctcaattttcagcctctgctgaaggtctcagttaaattttgcctaaaggtaccaaatcttagatatgtcattcctactgtatgttcaagatttgtcagtctgcatgaatagtctcctttattcaaaaccctgactcacttagactaaacaaataccctgatatagatcaaacttgcttagtcaatgacagaaattatagttaagtggccctgggtaatatcatctgacttgatcttatataagtaaagacttaccaagcttatcagaactttttattcatttttaaatgttattcatttatttttaagactataaaattagaattggatatagtcacgaaaaaactttaaaaattcagaaaaacacaaagaaggtaattaaaattacccataatcccattacttaggtttaactaattaatattttggtatatttctctcctcatatgtatattgctgcttaatataatgtaaacattttaatgtaagttcataaattaccaaatttctttatcataaaatgttagagtaggagaattcctctttcaaaaatctttactgaaaggacaaatccaaaatataagccaaatgaaagaagagctgatgtaagtgggggtggtgatgtggaggtgagaggtgagagttgggtgtgaaaggtccagaagtagacctgttggcctctccagtccctataatggctcccaaacacatctgaggaaccctgggtccccaaataatactgtttaaaaatcacaaatctagtctaactcatttaacagataaaactacttgcttttactagacagataactagtaaaagaactaatgaaagaacttaggatcccacatcttacagacaagtgctcagcttctgcaacttagctaccctttctacaaaagtcatcaaatgttcatttgtccattgttgttcttcctttaagaaaaatacaagggaaaatgttacaaacaaaaaatgaatcattaatataataagctggatctcaaggagttccacttgtcctaagcaggttctcaaactattcctcatattactatgagtgagagaaacattgatttctaaactaaaaagaaaggcatgattacattattttcctcaagaatacaatgcatgtctagtatacctacaaactgttccttctttttcactaattcaatcactaaatatttattaagaatctatctgggctggacagcagaggtataactgtgaacaaaacaaatggaagtcctgccctcatggagtctgtaagcctgacaggcttgagcaaactactttaactttctgaatcccagtgtttgccagtcataaagtaaggttaataagatttaactactgcattgtttaagaattaaatgacacgatgtacgtaaaaaaatccttataggtaatcaggcatataatatgtgctcagttaatattagttaccttccctgccaaagtgttaaatatcagattaaaaatgaaaggtaacagtgtaagtctctttgctattaaaacaatgatttgaagtagtacaactgaaatagcaggttaagataattccaaagagattctgggccaggtgcagtggctcatgcctgtaatcccagcactttgggaggctgagacgggtggatcacctaaggtcaggaggttgagaccagcctaaccaatatggtgaaaccctgtctctactgaaaatacaaaaattagctgggtgtggtggtgggtgcctgtaatcccagctacttgggaggctgaggcaggagaatcacttcaacctaagaggcagaggttgcagtgagccaagatggcaccactgcactccagcctgggagacagagtgagactctatctcaaaaaaaaaaaagataatgccaaagagattcttacactaggaaagaagtaaatatttcaatacgaagaaatgaaattgaggttgggcgcggtggctcacacctgtaatcccagcactttgggaggccaaggcgggcggatcacttgaggtcagaagttcaagaccaacctggccaacatggcaaaaccccacctcttctaaaaatataaaaattagctgggcatggtggcaggcacctgtaatcccagctactcgggaggctgaggcaggagaactgctagaacctatgaggcagaggttgcagtgagctgagaatccgccactgcatcccagcctgggcgacagagcgagactgtgtctcaaaaaaaaaaaaaagagatgaaattcacatgagccctcacagtcaagttctgtgattcaccttgttatctccatgaccatttactttcagttacttctgggctctttccacaacattcagccctgtatagtgtctaggaaagaaaatataaagcaaacagtcctcttctccaaataccatttattcatcatataaatatgggcagctaaacaagacaagatttacacttaacaaaataaacttaaaagacaatggtttaaaatacaaaatatcaaatctgaaacccaacaaaacctataaaggtttgatcaatattcaccaataaaagtacagaggacataagcctttttcattcatataatatgcagaaatcaacaaaatgtgaattgcaaggtcttagacattctaagagcaccttgtaagccataatgcactgcacacttgttaattgctaatattaaaagcactctgttcactattaactttaattatatttctaatggggaaattctgtcattcaaaagatcaaacatttgtttcttaacgaaattaattatatactggtatgcatctcaaaaccacctaccaacaaaaacaggtcatgttattcataaataggaaaataaatttgctacttattcaaagttcttgatttttttttagagccagataacttctattatgaaagttttttctttattgttcctcagaagaaggtggcagggggtaggtggggcataagttggacaataaagaagaccccagtggaaaaagaaaatcttttctccattttttttcaaaaagagagaataccgcattctgaatattgtataaaggatgacattttcatattaagaaggcttcataatctaaattacatagaccaaaaacaaatcaataggaaaaaagtgaaagtcacagagaaagacagattttgttctcagtgcaaactgttcaacgccatgcatgctgacactaacacatctttaaggactttttgttcatctagaaagacgtcttggaagaattaagctttgaggaagcactgaaggaggacaaagtggtaaattgttaaacagagagggtaatttggttccttaaagatcatggaaagaatggttggggctaaaaataaaagatatgagtgagaggaacgcatagaaggctttaaattgaaaaaaaatgagcaaggagaatggaagaaaggtttttttttttttcaatgaagacaaaataatagggaaagatttttctgaccataattatctgtagaacagtggcattattagagagattattttgatacaaatttatcacatgtactcacatggatacatctaaaaggataaatatttttagtaaacctttactatgattcaaacctaggtatccagacataatctttatcttcttcatcacatttttagaaatcctcctttaaagttaccagggcagtcagggtagtcatttctagtgaaaaacagataaatcaaaatgtatacttgaaaaaaagcctaagtgatcacagaagaggtccctgtaatataatgtcaacattactaataaggatttttatatcacacctaaaaaaaaccacacaaaaatcaagataaaggaaaaagcaaggattaaagctatttataacttaaaatatcatctaacactgtctttcagctaaacaaggtcttacatttttattttcttctgctctattaagtaccctagagcagaattctctccacccataatttactcatcagtaaaaacagcactgcaatacttttcttctattctttttataagggtgccagaatgtctggaagttaatacacatgtttagaaatgctaagatgagaaattatgcacacttaaattttaggggtcttttttaaaaatcaagataaaaagacctagattatttcaatgtgtaaattttcaactagccaggaggcttcctggggacataatacagaagatttgaaactaatgttctggagtttatgctgctccagaaactaatcagactaaggaatttctacaaaaacctaggcacttaggtcaggcataaggtatgataaatttggggggcctggccccccaaaaaatatgaacaaatctctccatcacagaaaaacttagaacctaattaatgaaacaataagagctataatttaatataacaattgtaaaacgttgtcaaacagaaaattcagggaggtggctgggcacggtgtctcacacctgtaatcccagtactttggaaggccaaggtgggtggattacttgagttcaggagttcgagactagcctgggcaacatggcaaaatcccaactctactaaaaatacaaaaactagctaggcgtggtggtgcacacctgtagtcccagctactctggagattgaggtgagagaatcatttgagcccaggaggttgaggctgcagtgagccatgattgtgccaccgcactccagcccgggacacagagtgagaccctgtctcaaaagaaaaaaacagaaagaagaaaagaaaattctgggagatgaatgaatagcacacagtggaatgaagacagtaaacgccaaggaagagtagaagttttcccagattaatatccaaggaccaattatttttagcaaaatggtttcctactcttctaggtagctgtatttctttaaatgccaataatatggattctggagccagacccactaggtttgaatgtaggttctgccagagctgggcttctatggaactcaatttccttatctataaaatgaggataataatagtaactaacttagtagttcctgttttggagattaaatgacttaatatatataaggcacatagaacagtgccaggaacatagtaagtgtgcttgtaattactattatagtagtccacaatccctcaaatctgatgctcaataccagaagctatgaaactacaaattttcctgtaactcacttggtggcaaatatctgacctactccgaatacatttggcaacaaaacctgacctgagcaaatgcaaataaaacctgacctgagcaaaggctactgaaagtctttatttatcacactcactgtaaagatacgtgcagtttgctgcagatatcttaatgtgtttgattacaggatgctgctcccaattcactggaatgtatttatgaaaaaatgaaaaaatctaaattctgaaacacatccaacccagaggttttagataaaagactgtggggtctatattaactttgaagcctagacagtttgtatttccttaaaataaatggcatcttcttaaagaaacacgagtaagtaagatcctgaatctagtattagagaatattaggatgatgaaaacattttccagtacagttaagagagtcctatattcctaggatgttcttttcaaatataatccatcttggctgggcgtggtggctcacacctgtaatcccagcactttgggaagctgaggcaggcagatcatttgaggtcaggagttcaagaccagcctgaccaacatggtgaaaccccatctctactaaaaatacaagaaagttagctgggtatggttgcgcatgcctgtagtcccagctactagggaggctgaagcaggagaactgcttgaacttgggaggcggaggttgcagtgagcccagacggtgccactgcactccagcctgggcaactaagtgagactctgtctcaaacaaacaaacaaacaaacaaacaaaaacaggctgggcatggtagctcatgcctgtaatcctagcactttgggaggccgaggtgggcggattgcctgaggttgggagtttgagactagcctgggcaacatggtgaaaccctgtttcttctaaaatacaaagaaaaataaattagctgggcgtggcggcatgcgcctgtagtcccagttactcgggaggctgaggcaggagaatcacttgaaccggggaggtggaggttgtagtgatccgagatggcaccactgcactccagcctggcaacagagcaaaactccgtctccaaaaacaaaacaaaacaaaacaaacaaacaaaaataaataatccatctgtaatattttgtttacatgtcatggtagtcagagttttcaagttctaaattctagggcttgcttaaacaaagtctattctcatcactcagataacaaataaataattaaggttctttgggggacataaatatgccttgaatcatgcagaccaaatcatcacagaactttagagctgaaagagaccctttaaaactaatctaaattattatcctttatcttccaaattgttttatcatctgtaaatttattctgccctatgaggtaagaataatctgccctaacttgtccgtagactctgtctataggaacacaccgcaggtaaatgcaaataaactgggtggagtacactgacaaacctgggatctaaaaggataactgaatttaacacaatcaatcttataaatttagttaatgtctcagattacactttagaaaattataagaatttccaagtccagaatgaaagaagactcacctagcacatatttaaaaataaataaattttaatagagcttagcaatcttaatgggctcaatgagtcaacaacataatgcggctgccaaaaagctactgtgattaggaactaaccacatcaacatcagtaccccatccagaaggaatgaggcaactgccctctctgctacaagctggttagagcacatctggagtattatgttcagctctgtttcacattttggtagacacagaaagactgaaaaagactagaagagggccaggcacagtggctcatgcctgtaatcccagcactttcggaggctgaagcgggtagatcaggagttcgagaccagcctggccaacatggtgaaaccctgtctgtactaaaaatacaaaaagtagcagggtgtggtggcatgcaccataattccagctaggcaggaggctgaggcagaattgcctgaaaccacgaggcggaggttgcagtgggctgagatggtgccactgcattccagcctgggcaacagagtggaactccatctcaaaaaaaaaaacaaaaaacaaaaaaaaactagaagagaagtaaccaagacagtaagaaaatttgaaaccatgtcacataaagatcagttgaaggagctgaaattatttggccaagacagagagggatcatgatccctgtcccctaacctgtaagagctgtcatggcacagagacagccaactttttctgcatggccccaacgggcagagccagatcaatcagttaactaaagtaagaaatttcagctaagcctatggaaatatttcttcaaatgtagagccacattaggaggtagtggcatttaaagtcctatctacccctaagggtccataatttttaaaatcaaacatttgggccagcgtgcggcagctcacacctataatcccagcactttgggaggccgcggtgggcagattacctgaggtcagaagttcgagaccagcctggccaacatggtgaaaccccatctctactaaaaatacaaaaattagccaggcatggtggtgcgcacctgtaatcccagctacttgggaagctgaggcaagagaatcgcttgaacccggaggtggaggttgcagtgagccaatctagcctgggcaaaaagagcgaaactccgtctcaaaaaaaaaaaaaaaaaaaatcaaacatttgtcattaccttagtgtcttactgattattattacctctggtatcacagcatctctcttcaccctgcttaaaatgtcctacccagggccaggcacggtggcttacacctgtaattacagtactttgggaggccaaggtggacagatcacctgaggtcgggaatccgagaccagcctgaccaacatggagaaacactgtctttactaaaaacacaaaattagctgggcatggtggcacatgcctgtaatcccagctacttggaagactgaggagaatcgcttgaacccgggaggtggaggttgtggtgagccgagatagcaccattgcactccagcctgggcaacaagagcgaaactccgtcttaaaaaaaaaaaaaaaaaaaaaagtcctacccagccaaccaatcagtgaatgttttgctgggtttgtgggagaaaaagtgcctgcttgctgggcaattagtttcagtttgcagatcagtgtccttgtaaacaaaaaagggccctaactgaggggcaggcaagagctctcagctagatctccatgaaagaaattattattaattcaaaaagcatctataagacctattcaatcaaataatatattatcagtggcattagttcttacaggaacgttgaaattaaaaaatactgtacaaccatcttctcaaatgccagggaatccaactttgcaagccaaaccagttgtctcaaattcaattataagttttccttctgccaaagagatatgttttctgtttaaagtagactggagcccatgctccatacttgatcagatcactgtaaagtcaatttagctgctgagaactagatattggcaatctagagtgaattcacagagaagtacaaactacctaatatttaaaacacaggaaagttatcgaaattggacatccttccaagattttttcacccaaagaccatcacagacgtaagtataatgttagttcatgaaaattattaaaagccttgaacaacagttcagatgacaaatattactcaatccagctttactgcagtgtatactgaattggattctaagcaactccagtgaaagtattagagaatatagtaaatagatgatggatttaacaaaaatactctgtgctgcttcctctctgctttttaaagtgaagcctagaagcaatctaagtgtccataaataagggcttggttaaataaattatgatacattcttaccctggaaaatgcaactattaaaaagaataaagtagaccctagataccgatattttttttaaaagtccatgatacatagttaagtgaataccacaagttgcaaaacatgtatagaattattccattttgattttttaaaatctatttttaaataccctgtgtgtatgttcatatatgcccagcaaaaacagctgaaaaaagatctgacaaattgctaacagtagtaacctctagggactgactgaaactaggaggcagtgaaggagtgactttccctttttcctttgtggacttctggttgtttatatttttttgccagtaggggttacctttggggttgaaaaataacaacacaaaaatagtaaaagtaaaataacatgaattacacagatttatttatcagatactaaccaaagtaagtgatctttctacttaaatgctactgtatgcttaaaactccagagaatctaattcattctttttctattatattttactaaaacaaataaaaatcaccccaagtccctactagttttctcaaatgctttctatacatacatacatacacacacacacacacacacacacacacccacaggcctggtcataagcatagctaacacacacggtgcttattctacactaggaactgttgtaagcacagtaagtgttaacttatttaatcttcccagcaggcctggtgaagtgaatcatgcctgaaatcctagaactttgggaggccgaggcaggaggactgcttgagttcaggaactcaagactagcctgggcaatatagtgagccctcatctctacaaaaaatacaaaaaattagctgggtgtggtgacccacgcctgtagtctcagctgctcaggaagctgaggtgggaggatcgcttgagcctgggaggcagaggttgcagtgagccaagattgtgccactgcacttcagcctgggcaacagagccagaccctgtctcaaaaaacaaaaacaaaaacaaaaaaagtcttcacagcaaccttatgagttaagtactactataatattatcttcatttcacaatcaaagaaactgagtccaaagagcttcagtgagccgcctaagcttacacagctaacaaggggaagagctaggattcaaacctaagaataaactccagagtccatactctcaaccactatgcttcctgtctctcagtaatatgtcaatctctctatatgaaagccaaaaggggttacaggtaaaacccagctagctaatgcattccttgaagctggaagagatgcacacttggctttttatgggtgaataatcctacttatgtcattgccaagctccaacccaaggatcaagactgtattaaggttcataaccatgtgggaaaattctctacacactcaattatagtccaaagtccatacctgactccacagtaaatcactaagcctaagatttaggtcagagacccagctagacaaaggatttggacaaacctccaccccaactcaaagcaagacaattcagaaacttttgtccaaacgttctgacaaagtaggcttttgttttgttttgttttagtcctaggcccacttaagatttaaacggggaaagaatacgagttgtctttaactttgcttgaagacttcagcaagaaaagccttttctacgtgggctcaaacagaaattggcatatatcagcatcagcaaagttgaacatcctggcttaaggagacaaaaataggcatccttgcttaaatggtgtatttggccaaacatgttgaccttataattgtggaagaaaaaaatggtgcgaggaagagatttaacctaatttgtaaatgtgctcagcctagatacacacctgtcccaaatgacctactgaatccacttatttgcagggacaacatggattacaatgccttttttgtttttattttttgccctcaagtggtccatactactgtttgtaaacaaaatcctctcactacctctcttccacctgtcatacacacacatctgatatttacataaacaagaagaaatgaacagggaaactggagctttgggaggaattccttaccctcagcttttgacccagtggttgaaggaggtactatgcgggctttcaaacttccccaaataacccaggcagagaggctgggtgcgcgaacccaacccaaaagtttgcgcccattctggtctctgaaaaaggccagaaagccctgttgggaagaagatgagatgccttccacccagcagccaccccctcccgagggagcacagcccacgggggacaaaagactttccagattgatcgggggcgggagggagactagctggacctgggatcccccctcgggagccggaacctggggtgtctttggggtaacaaacgataaattataggcaagagcccaaccctagattgccggggctgaggtgaggacgggtcctgcccgagagggagcgccggactcacctggaggaggcgaagagggggcctcggtggcaggtggggtggggaggacgctgctgttgctgctgctggggagatcgggggtcggggtccggggagtcgtgggcgccggtacggtggtcgctacaggggtggtcggcgccgggccagtggtcgtcgaaagggtggtcggcgcgggtctggtcggcgcctgagaggtggtcgaagtgcgttccgccgccggaggggtggtcggcgaggggccgagcggcgcctgaaaggtggtggaagagggtccagcagtcgcccaaagaggggtggtctccggggactgggctggagaagtcgcagccaggggtcggtggacggtggcgcgcgggggcccggtcctcggggcctgggccgtgggagccgtcgccctagggaaggggtggctgggctcgccccgcaacccggggcccggcgacgcgtccacctgccccgcggccccgccgccaccggtgacattccccgccgaggcggctgaggcgacggcggcggcggcggcggcggcggcgcagcacaacagggcgaggccgcccaggctcggcaggctcctcatggcgcgctcggctccgccattcattcattcagccagtcggttggtcagtcatcttctcctcgttgcaatccgaccaaggaagcctccgcaaccgccgccgccaccgccaccgggcgcaccatcgccacctccctctgacaggcggccggccccgcgggcgggccccagcgcggagggagcgaccggaccgagcgcggaccgcccgccctcctcgattggcagccgcgcctaaccaatgggaagccacagtcgcccacgtgatccgcccgcttcccggcctctttgtagccccgtaggccaatcagaggacgtccaggagagggggcggtccgtgaggcgggagaagggtggtgcgagcccagctctagcccgccgggctcgcggcggccccggctttgtctgcccaaagagtggggcgcgggcctcgggcaccgggcgccgcggagcagacaaaggatgcgccccgcgcggcagacgccgggcctagtcatctgctccaccgggctgcgagcacgagcggggggtggaatcagcactcgggagcatccccgccctcctgaacaatggggcgccagcgccgcaccccagctcgggcggggaccgcgcgggaaccccgcgatgggagagggcagcggcagcgacgatgtagagcttggcatgccctctgctgctccagagagcctggtcgcagccttgcgaggtctctgccgccattcccatttcagagatggggaagctgaggcccttgctgagggcctccctgaaccgagacccacgccctcaccagaaacctgctgtgggccaggtgttgtgccagactggacaagggggcgggaccgggcggtggagacccctgagggcagaaggtgcaagcttcctgcgtggaggagacaggctcgcaagcacacttacctaaaccccgggaagaataggatcagacagggttgaacctcaacttgatgtcttttgctgaatggttttgtggcctgagcgcggttttttcaccactaaaatggagatgataggacacccctcaccccccacccccctcacagagctgttgtgagaattaagtcatggacgtaaagggcttagcccagagcctggcccactgttgtaaccctcattaatgctaactattctcagcatttgcgccagggcaagcccaggattagaaagcagccccaggccacagcccttcagtgcccccagagcctccggctggttgcaggggttggggtggggctaatagccgagcttgaccctggatgacactaaaccctgaatcaagctggaattcgggcacgcagcctcgcatcatccgcccaggatccagagctaggtcaggcgctgctgcttcggctcagcagcttccagaggaagccaggcagggcgggtttgtcatctgatggggcttaattcaagccccactgctaacccaatcccggcctcccctacgtgatgtttggctttgtgcatggtttcccattagtcattggtcttcaaccagaccagcaggatgagatttatgtgtgaacccgtgtatgttaattaaagcatgcatttattttcctgcatgagtagtgggtgggggaggctgtgtatgaatgcataaacatgtttgtgagtctgtgtgtatgagtgttgtatgtatctgtgtgagtttatgagtatgggagctagtatctattttcatatattgtgtcttaataatctgtgcatgtgtactggtgtgtgtttttgtgtattttctgtgtttttgcatttgtggttatctatgggtgtgtcttgataggtctatgtatataagacagcgggaatgagggagaatgtgagtgttctgtcttcaggaccaatatttagcaagcactaaccaaggttctatttttactttgctttgggagggtggacaggtcatgccagtcccccatattcccttgctgaccctccctggcccttcaaaccccaaccaaaatgtcacattctctaaaagacattcctggatttgagtgggaattaatctctcccttctcatttccccaccaccccttgtttatgcattgattacagccctgatctaccaatctacctctccgttgcctcttcctaaaaggattaaggatggctttcagaaatatatacaacaggataaattgtattgcccacatggctttattacttctcataggcatgcatcagccttaatactagaacttgttatttatgtgtctgtctcttacgtcagatgttctccctgttctgagaacctagcaggggcaacacatgtaagtgccaacccatgctggttaaattgaattaattgaggtcttgtcgtgcttgtgggaggagcttgtgtctttagagtcagacagacttgggtcatgactgccaactctgtgaccttggaggaaacctttcacctctctgagcctcagttttcccccccacttttttttttttgagacagtgtttcacccttgtcgcccaggctggagtgcagtggggtgatcttggctcactgcaacctccgcctcccaggttcaatcgattctcctgcctcagcctcccgagtagccgggattacaggcacttgccaccaggcccagttaattcttgtatttttagtacagacggggtttcaccatgttggccaggctggtctcgaactcctgagctcaagttatcctccggcctagacctcccaaagtgctgggattacagacatgagccgccgcgccaggccacttttctcatctattaaatggggccaataaatagtctctcatttgttgactaggattgaggagaatgtttttacagagcctagcacacagacggtgctcaagctgtgtaggttcatatttttgttataccattgctaactttgagacttgttggctgaaggaccagagcagaaacccctgccccataagttccccatcaggtgacatggcctgacacttgccctacctgatatttccaaatgatatctgaaaaatgctgggttggccctgagctttgctgtatcagaggttctctggcaaggggaaaaaagctgatgcagcttcttggccaggagagccacagagcaaatgactaggagaccttgtcgagtgattcaggtcagctctctgccttaggcaaggatcatccatgccggggcttttaagatgggatattagcctgtcatatgtatagaaaatattgaatttttttgaaagataccagtaatttaaatgtgttaatgtccattcaacatttaatttttaaatttccttaatcttaaatcttccttaatctctaaactacaagatgactttcttaggaattatgtttgtgtttaaaaattggaaataccttacatatctgtcatcaaagaaaggtattattatacctgttaaatttaatcctagaaagtcattgtaagtgtagctatgaagacagtatagcaaatattaatagtaaataattgagctcatagtctatgctagacactataccaagagctacatatgaattgttttgtttaatcctaaaaaccccaggaaataggtactattatgtcttagtccatttgggctgctgcaacaaagtactgtagattgtggcttgtagacaacaaaaaatatatctctcccagctctggtgcctgggaagtccaagatcaaggcaccagcagattcagtgagctccctgggtgtcctttaaaaggacactaattccattcatgatggcgctgcccttataacctaatcatctcccaaacgcttccaaatacttttacatggggagttaggatttcaacgtgtgaattttagggggacacaaacattcagtctatagtctattattatctgcattttacagctaaggaaactaggtcacaggttaagcaacttgcccatggtcacttagtaaataatagagctagaaatcaaactgaggctggctggctcccactgacacccttaactataaatggaaaatcctcataatggtaagaagaaaagaaaaaataaaaattatagctgtgacactctgtgtaacagaacattgactggcacttttcctatttgccccagaactgtagctaaggcccatgagacctggagccaaaggcttagggaaggaccacagaacagcaggggtcagagtgggccttgttggagccaatgtgcagcctgacttttctcctaggcaaatgaggtgctctaaagggccccaactgatttctcactttattagtcagcaccgagcacagtgtcaaatacacagaaatggctcaagaattgtctgtgagccaggcacggtggcttatgcctgtaatcatagcactttgggaggccgaggtgggtggatcacaaggtcaggaattcaagactagcctggccaacatggtgaaatcccgtttctactaaaaatacaaaaaagttagccaggcgtggtggcggacgcctgtaatcccagctacttgggaggctgaggcaggagaattgcttgaacctgggaagcagaggttgcagtgagccgagatcgtgccactgcactccagcctgggcgacagagcaagactccatcttgaaaaaatttttttaaaaaattgtctgtgaagtcttatgatgtggcagatgctgttccgggagttttatattcggaacacgtttattcctcaaagacagggctgtcatctgcacttcaaagaagaagaaactgagcctccaagagcttaagggacttgcccaaggcccttgtgactcaaaagcccaggctcttctctatacactacagtcgttaatgtggccgctatgtgttgcacatactaggaggtcagtgaacacatactgaaggaaaggacacacatgcaccaaatttaacccttctgctagaaaagcatttaagaaaagagaagctttgggagtgagaaaagaaggtataatgatatgatacatagggctcagcaaaataacttcatctcccagattccaataaaacacagacacctttcccctttctggtttcattgaaacagcaatgctgacatggactatttctaatcctgctggaggctggcctcctatcagatgtggctaaatgcaaggtttggcatcttctgcagacaactgtaggattactggggccactgttcacaaagtcggcccagcaaaggacactaacagacaagccacagaaaggaatacaaatgactaaaaaatatgaaatactgcatatgcaacttgagtaattaaagcattgcaagttgagataaggagttgccatttttttaacctattgatttggcaaaaatttttacaaactggtaatacttgttatggtctctcactgttgatagaaatataaagtgatacaacctttccagaaagccttaaaagtgtttatactctttgacccattatttccactttttttttttttttttgagacggagtctcactctttttgcccaggctggagggcaatggcatgatcttggctcaccgcactctctacctcccgggttcaagcgattctcctgcctcagcctctcaattagctgagattacaggcatgtgccaccatgcccagcaaatttggtatttttagtagagatggggtttctccatgttggtcaggctggtctcgaattcccgacctcaggtgatctgcctgcctcgggctcccaaagtgctgggattacaggcgtgagccactgcacccggctcattatttctacttttaataatctagccaaaggccaggcacaggagatcatgcctgtgatcccaacactttgggaggcttaggtgggcagatcacttgagcccaggagttcaagaccagcctgggcaacatggtgaaaccccgtctctactaaaaaaaaaaaaaaaattactaaaaattagcatggtggtatgcagctgtagtcccagctacctgggaggctgaggtgggagatcacctgagcttgggaagtcgaggctgcagtgagccatgatcatgccactgtactccagcctgggcaacagagtaagaccctgtcccaaaaagagaaaaaaaaaagaatctatccaaaggaaataaataatcagatgtaaatatgtatgtacaaaaatgttcaccagagtgttatataattacaaaaattagaaaaatctaaacagttaacaaaggattagttgagtactttgtgctgtatgatgtttctatgtagaaacactatacatctataaaaaatgatactcacctgcctagcactgcctgcccaacactgcccacccagtgcctgtccccagactatggcccagccccctttgcccttgtccatcaaaggtgccgccagcatgtctgacaaactgccctacaaagttgctgacatcggcctggccacctggggacacaaggccctagacattgtggagaatggatgccgggtttgatgggcatgcaggagctttactcggcctccaggccactgaagggtgcctgcattgctgactgcctgcaaataactgtggagacggccatcctcattgagacccttttctccctgggtgttcaggagcagtggtctagctgcagcatcttctccacccaggaacatgcagtggctgtctttgccgaggctggcatgccagtgttcacctggaagggcaaaatgaaagaggggtacccgtggtgcattgaacagacactgtacttcaaggacgggcccctcaacatgattctggatgatgggggtgaccttaccaacctcatccacaccaagtacgtacccacagctcatgtcgggcatctgaggcatctctgaggagaccaaaaccggggtccacaacctacacaagatgatggccagtgcaatcctgaaggtgcctaccatcaacgtcaatgactccgtcaccaagagcaaaatttgacaacctctatggctgccaggagtcccttatagatggcaccaagtggaccaagacgtgatgattgccagcaaggtagcagtggtagcaggctatggtggtgtgggcaagggctgtgcccaggccttgcagggttttggggcctgcataatcatcaccgagactgaccccatcagtgcactgcaggctgccatggaaggctatgaggtgaccaccatggacgaggcctgtcaggagggcaacatctttgtcaccaccacaacctgtgtcaatatcatccttggccggcactttgagcagatgaaggatgatgccatcttatgtaatactgaacaatttgacgtggagatcgatgtcaggtgcctcaacaacaatgctgtggagaaggcaaacatcaagcccaggcggactggtactggctgaagaatgggtgccacatcatcgtgctggctgagggttggctggtcaacctgggctgtgctatgggccgccccagctttgtggggagtaactccttcaaccaggtgatggtgcagattgcgctgtggacccacccagacaagtaccccattggggttcacttcctgcccaagaagctggatgaggcagtggctgaggcgcccccctgggcaagatgaacgtgaaattgaccaagctaactgagaagcaagcccagtagctgagcacgtcccgtgatggccccttcaagccggatcactactgctgctgagagtcaggcctgcccttcactttccagctgctgtccttgctcaggccccgcctcttctccctaagagcaaatggcaccaactttgtgattggttggttagtgtcccccatcgatggggctggtcactcagtttttggcctctgctgcatccctaacactatatcaagtgtggcggggaaattgagaggcccctcctcaagccctggtcatgatggaggtacaagggaggcatccacaaggaaccatgagttgagtggtcttggaactgctcactaagtcagtccttccttttttttttttttttttttggtatttttggtagagacggggtttcaccatgtgggccaggatggtctcgatctcttgccctcatgcctcggcctcccaaagtgctgggattacaggcatgagccactggcgcccagtcagtccttccttagtttggaagttggtagtggagtcacaaagcccatgtaccttaccattcaggtaaggttcctggtctgtggacttataccgtgttcctggtctgtggacttatacccgtggtttacaggttcagtggttccccagcccatgacagatgagaaggagctatattgaaaggcaaagaggaactgttgtttgaattttcctgagagcctggcttagggctgggccttctcttaaacctcataacaatgaggttggtacttttagtccctgttttacaggggtcagaatagactgtaaagggataactgagaaaggacagagaagtgacagccagaggggctataaaaacataaaagcaagcatagatctgctactactttgtaacaagatggttcctatcacaaccctggttcaaaaagagaataatatggttttaatgttaaaagaaagcaggaaggtgggtaaataaaaatcttggtgcctgaaaaaaaaaaaaaaaaaaaaagatgatactcaagcacagtggctcatgcctataatcctgacactttgggaggcccaggcgggtggattgcttgagctcaggagttcgagaccagcctggcaaaatggtgaaaccccatctctaccaaaaatacagaaaaatttgcctggcatcgtcgttgcacctgtagtttgagctactctagaggctgaggtggaagaatcacttaaacccgggaggtggaggttgcagtgagtggagatggtgccactgcactccagcctgggtgacagagtgagaccctgtctcaaaaaaaaaaaaaaaaaaaaaaaaaaaagatacttatgaaggaaattcttataaaattgtggaaaaaatcattaatataactatttatgccatgattcccaaattgtgtaaatgataatatgtgcagagaataaaataccaaaaggaaatacaccaaaatgttaacattctttttttctgagtgactgcattatggatatttaacttttttctccttcatagttttctacattttccagtttttttaatagtgagcacttattactctcaaaatcaataacaatcaacaacagaattcatttgaatctgaagatatgtctctgccaaccacatccctgacctgccttcatggtatctcaagatgatgagaggaaggaaggctcaagttgtaaacctacattaaatgcaaggcaccatccccaaacaatgaagctaaatgttgaaatcctgcttcaaaggccctctgatgctaaaataagcccagaaaagcatttgctgcagttcttggagatctactgaaggacgtcattcacagtgggcaccaagtcaaaccctcactcgtcatcagtgttggctgcaatacaaagaatttgaaccatttgggggaggaatagggttagaccttcacaaataactctatcccttaggttgctatcattgtaataaaggggattactgacaggtgcacagcacagagctttcccaggcatcatctcatgtgaacttggcaacaactctggaggaaagacgttgatagtaacaacaacaataacaacaatgatggagacttaacatttactgaatacttattatgtgtcaggaatcaattctaaacacttcacatacattgtgcctcttaattaaaaagcaaacacaaaacaaaacaaaaacagggacttgctctgtcacccaagcttaattgcagtgacataatcatagctcactgcagcctcaaactcctaggcttaagtgatcctcctgcctcaaactcccgagtagctgggactacaggtgcacattaccttttaaaatttttttgtagagttggggtcttgctatgttgcccaggctggtcttcaactcctggtctcaagcaatcttcccctcagcctcccaaagtgttgggatttcagg

SEQ ID NO: 83 - DNA, 41676 bp, Homo sapiens
taactctgcctgtgtttgcatgccacctccagaaccactaaaatataatttctcagtgggtgactgagtaagactggcagcaattgcaaaagcagattcatgccatgtgtcactcttcacagtcaggaacttatttacctcttggaactttccaaaggaacgatgatggtggcggtaatgtcacattagtatggagcccttaaattcagcagtgttcaacctgagggaagacagagtaggtcaattctcttggcagcagctgagggaaggagagagcagggagcagggctcagataaggtttgtttggcagggtccaagcacttcatggaatggagacctttggctgtcagagatctgaggaagatttgtcagggcctgctacactctgagggcttgcagtttggatggttgggaacacttcttccttgcactgatggtgctcctatttctatgacacgtgtactagttcagacacaatttattgtgttcaccaattctatgcacagcaatcagactgagattgaaatccagtataatattaaaggtgatctgggccaggcgcagtggctcatacttgtaatcccagcactttgggacgctgagttagggggatcacttgaggccaggagtttgggaccagcctgggccagaaaatgagaccccatctgtaaaaaaaaattttttttaggttagccaggcatggtggtgcatgcttgtagtcctagctacttgggacactaaagtgggaggattgcatgagcccaggagttcgaggctgtagtgagctaagattgtgcctctgcactccagcctgggtgacagagcaagactctgtctctaaaacacacacacaaacaacatctgacaaggcatttcagcctggagtcagtcaaaaaatcttagaggtctgtaaaggagatgactatgctgttagggctgtggtagaaacctttaataacaagtgaaaagagcttgtatttgccaaaatgaacacaggatatgattctttttttgcttttgctttggagttgtatcagctctgtgcggtcacatgggtatctacaaatcaaagcacccatcaaccagatgcatctctgagagttaacagcagaaggtggcataataaaagaagttctcggtagtgaaaaaggttggaaaccaccagctaaaccaatcctcttgtaccaataggagattcaagttgagaggtgggaaagggcctatctcagagtaggtgcttgaatacttcttactagaatgaaagaaggaacttaagatcacacagccatgttactgcaggacggggaatggaacctaggtcttcttatttttggttcagtgttaactcccattctctaagcagactgggcctgttattcaaactgccttcccataggtgcttccctgcttctctcctcacccagagaaggacttacaaacagcttatcttcagaggttttgtgcctgatagttatggaatgtgctggtttgagcagggaggatgtaaggggagggaatgctaaaagcctgtctacttagagtcaggtttcctgggtaagtccctggaaccccatccccttcccctttcttgagaccccaggacttgctccagtaactgccaccctgtgcctttgcttcagggccatgctggataaggagctggctgcctctgtgaacatcctactcaaggcatcttcactgtgagttttgctgttgccattggagggggagtggggggagtgtggggagtgctagggtcaggtcctggctggtgtaaagaacactgaattaaaggaattgtcagaataactcaaaggcatttagataatcaacagtccatttcagtgtttttattcagagatcgatcgatcagtgggatgttgtccaacaaaagcaaaaatagactgtatagagaaggaaggaaaaactgcataatttaggaacagtatatcttgtttgcacattctttggttaaatcaattagcctgctgttaggaaggaagtctgggcattttatccttgagtaaaccaactagggatatcagagaaaacagtttccaatgcttttggattctccagaaaacagacagtttagcatatatgacaggctgcttctgcgtattgtctacctttcatttcattaacaacttcactttagaagcctggtctgcaccatttccctcatcacaatactttagcatcctggcactagctgtgcaggatttgtcgtacgtcttcctttccctgatgatcatgtttctcatttccttccctctctcccttacaccctcaaaagagagagacataatatacattctcaaggtcatataagctatataatgaaagctacctttttctccccagtgatgttatttcctcagtggctcacaccatctgtagtcatagttcccaaatttggccatgcggtctatccctgaactccagcctcaatctattcaattagtcgccctgaggatggggcccaggtctctgaatttttaaagacttgtatagataagtcacatttagccagtctgggaaccagtgttgggaaattgaatagaatttcatcctactatttcctttatatgcccatcctttctcgtgatgtattattttgccacagtcctgtgacacaggaagggccagtggccttggtcatcttagatttgcccttgttgatcttctcagggtaaatgtctttcctttcccctgatggtgttcttatactgtcttctgatcatcatttctgactttgttttcagcatctaaaagtttccataactataaggcttacttcttccctgcagtcttccgtgtttttagttattcatttatgggcactctccttggaaagtcagtgatcaaaatagcactagtgtgtaggatgagcactggaagagctcaagcagagaagacataggagtttctgcagggctgtcctggggtggttcttgatgaggccagttggggaaaaagctaggtggcagatgttggcacactataagaaaaagcatcttgtgaaaacctttaagttagatggacttcatcaagagatgatgaacctcccacctccaggaatgttcaggcaaatgccagatgcatgcattggaatcgttggaccagatgacatgtgaggccttggtcaactctagacttgtttatataggcttggaaagattttaaagttttctcctcagtaggtcacttaggtgggccaggtttgacacttcactgagctcctcttaggagcatcataatttggttttgttcccttctccaggtacttttgggagggaaaaatagaagccactaacatcctgttagtgaggatgtgagtgtagggagtctttttttttttcttttttttttgagacggagtctcactctgttgtccaggctggaatgcagcggcatgatctcagctcactacagcctctgtgtcccgggttaaagcgattctcctgtttcagcctcccaagtagttgggattacaggtgcccgccaccatgcccggcttattattttttttgtctttattttttggtagagacagagttttgctatgttggccaggctggtcttcaactcctggactcaagtgatccacctgcctcgccctcctacagtgctgggatataggcatgagccaccacacccagcctgttgtttgttttttcttttcttttcttttttttttttttaaccattagtgcaaatgtcaacatagtaaaaggataaataataaaataatattgttatgaaagtagttttgaccccatggaccccctagagtcctggagatccccatgggtcagtggaccttcactttgagaacctctagtataaacctttatcattcagaagtggaatttttggaattggcatcacctgggagctttcaagaactgtagaatctcctgctcaccccagacctaccgaatcaaattatagtttaacaagacccccaggggatttctgtgcacattaaatcttgagaagcactggtctaaaccagtgtttctcaccgctggctgctatgtattagcatcacttggaaacatttttcaaactaccaatttaggccccacctcacagatttcgacttaatttggccagggcggggatcaagtatagtggtactaaaaagcacctttctttttagatgactctaacgtggtcacctgaaccttctgaggttgactctaacgtagggccagagatgcaaaccacctatatggatgatgaaaccttttctttactccttagggaactaagattctgtgaatacaccgttcccctgggtctcaaactagctctagaggaggccctcatgataccacctcagcagaggtgagagagtaaggaaccattggtagagccagtactgtggagaaattaaaatttaactggtgagggacagcttcagggttaagagagttggacctcctaccttgaaacctggctccccacctgccactgttccatagtgcttggaaaatatgaatattttatgtgcctcagttgccccttctgtaaaattgggattatactaatgggttgttatgcatatggaaattaatatgtgaaacctgtacatgaaatgctttatcagtctcagctcttattcctaatgtgttaaaaatgtctttgaattctgtatgtctgcttataaaaacacataagttaacaaaattcattatcctcaggcacccaacgtacagaatatttaagcatacatttgaagcaacatgtgaatgtatacatatgctgtgatttattaagcatgttacgggaactttaaaacacctcattcagcagaaaggaggcagaggattataatcctcatttgacagatgggacactgaggcccaagtcctcatgttccttcagtctagaaagtgaagagaacttgcactgtgtgacaagggccaggcgaaagacacaggagaggaagatagattcctgtagaccttgtttgtcagggaagatcccttgggaaaggtcagtggttgaattggaccttgagggacagagaagtttttttttttttaagcaagaataggcttttgattgatcagcaggagcaggtggaatctaggtgggcaaaagaatacagagatactgggggaggggggattgttttgggaagtgatgtgtataggataataataaaaagagtagctcacatgtaatgaatgcatacagtgccagctggtatactgggtaagtgctttgtataccttgtgttaattaatcctcagcagtccagtcatgtagggccttttttttttttttaaaaataggagcatttaaagaaaactaagtgacttgtccatagtcagacagctagtaggggcaaagttagaatttgaacccatgtctgtgagactctaaagctatctggcctaactggccacttattgacagatgggaaacataggctagggagtgacaggccgtgggcctggacaggtggggtgcggcaggttgcagagggcctcccttgaggctggccagttgggttttatcacgagttgattctaatcatagtcacttatagggctttgctttctctccaaaggctgtacatccttttgaaatcccagagatcttcagtctccctgtggattaaggagatgtgcagtatttaaagtggcttcaggaaggcatggaagaggactgagtggggaaagctttttgtgcatgctgctggctacctccagcggctgcctccagcctccatcagctgcactctggggaagaggaggctgccttctacctcccagcatctctggatttcatgttcctgtcagcacagaggagctaaatggcctgtagaggctgaaggtctgaggctcctaaagctggaagaaaaggctgggccagtcaggccaagcaagaacacagtgtaacttgtctctgagtgcttcatggttaagggggctaagcaggcacaagggcatgaggatggttatatgtacagactgaggggaagaagcagtgaagatgagacttgccatcttcttgagtcagtaggcctgcctcaggtgcctaggatgtaattgctctgctgcttctcatggggaggagtggccctcatgaccttgtttacctggaagagtgtgggatgaatgcctcctcctatggggactcgcaagtgctttagcaaaaggataaattgctaattgtggcatttcgtggatcagcaggattatttctccttgctaaagaggattttgttggtcctgaattctgaggaggtgggactaggaatgggctccatgagcctgtgtatgactcagggaatattaggactttggcacagcctcatgggttgggagtaagtcttggctcttccctagcctgaatgacagacatcagatcattctggtgctttgtccatgaagatgtagattctgagcccacccaactaatcttttcacttgagcacagaaacagccccgggaatcggacagacccgtgtctttcaggtttgcttcacagagccccaggggttgacaataggtgccttggagactgcctgcatggggatttttaaaaagctttctttgttaaaggtttgtaaaccactcctctgagcctgttttcattttatagattattcagggaactgaactgcacagagatccagaaagtgggtagtgcaggctgtagtgctgataactactgtactacttggatctttgtgctcccaaataccaaatggaagaggatctctgagagtcctttgcaaagatcttgtagggactttaggctggggccttcggaaaattccagaggattccaatggagattttgagggactgactcagaagaacaaagagaatgataatggtgatgtccctgctttttacaacagatcatgttctgatatatatgcaaatctgtgtaaagtaaaccctacctaaaatgtactggggacccaagatggactgcctgtattgcttccaggataaagtccaatttctagctctggtttttataaccttgcttcagctcaccttttccgtcatcatcccctccatctcctctcccacgctgggaaatggatggctgcactatactgtgtgatgttattgctatgttcatgccatcccctctgcctggaatgcccttctgcatgaatgcctgtgaaatgttgttgctcctttgtatggcctggcttccgtggttggcaggaatctcttctttcgtggtattcctgtcatctttgtgcatcacagtcagctttgtattcctagcttgtaagctacttgaggataggggcatgtctgaatctatttaatctcttgcacctgtttggcaaattgatgttttaagtatttaaataactaaagctctctctacagtacatactcacttttgatttatgaattggcaaaattcaacttttttccttgaatattcttaaagtgagatgaattccaaaggagagtgttctgtgtgtggccttcattgagtggttttctgttaccagaaagctcttggtggccttcctcttccctggtgtcaaggttgactgttataggaaatgggaggggagagggccgtttctgccacgcattgtcctaggttcttaacattatttaatccttataatgcaatgttatcctcattttacagatgaaacctgagaccaaagaacatgtaacacataaagtacattgcagagttaggatgtgaacccaactctgattctaaacctaatgctctcactctttcattcagaggttcagtcagttctttgtaggctgtagatccagagaagctgccgtagccaacaatgaagttgttagtttttaaaacatctatgtggtaagttggtctggcacttaaaaatgtattgtttcccaggcacggtggttcacacctgtaatcccagcattttgggaggccgaggcaggcggatcattaggtcaaaagattgagaccatcctgaccaacatggtgaaaccccgtctctactaaaagtacaaaaattagctgggtgtggtggcgcatgcctctagtcccagctacctgggaggctgaggcaggagaattgcttgaacccaggaggcagaggttgcagtgagccaagatcatgctactgcactacagcctggcaacaaagcgagactctgtctaaaatatatatatatatatatattgtttactactcaccacagatctgcaggagttcactgatctctaggatctgccttaactccaacttacatgttttggtcactattacaaactgtcatcccagaatgatgctgcagaggctagggctaggacacagaccagtgtttccatgtgggaattccctcccagtatttcttaggaaatgtatgttttttgaatccataatccctagaaaaatcagttgaggaaatgagaagtattgtaattattctgtgaatagtaacacttaccattatggagacatcactagtttgaaagaatccaacttcatcaaatattaacgtaccgagttgaaggctacaagaactgagacaggagcatagcagagagaaacggtcaccatctcattagccctatttttggttgttgtgatgccattacatctgtatatctggccatatcagctgctaatggtgagttcttgcaaacaaaatgatttgataaacaacctaccatactttatacaaatcttatggtgttccgagaaataaactttggaagcaaaataagttaacagtctggacacgattgattctatattctgtttaccttgctctaggctattcaaatgttatatttatttgaacactatccaatatatgttccctggcatcttcctgtcttttaaatattctctgtacgctacagttctttgtaagtaaaaataagcttaatatgtctacttagcaaacaaagtttttccagatacctataataatgaggaaaacagtataaagaatgaagtatttgaagaataacttataatttgggggatttctgagaattctacttctttgtccctaatttccgaaggtaaatgtttgttgtgaatttggaaacactagactacagaaaagcaggcactctctagcctgggaggcccactgatcttaggagggtccatatagctgcttattgcagaccttgcactagaacccaggtcttttgacacctggtgccacttttcattccattccattaattatagcccagagaataaccaccaccacccccaagtcccattgtggttttattctgaggacagataaaaggttgaagctgatggagtggtagaaagaagtgggagccatagtgaatgaagacgtttaagggcagatattaacaccactgagtccttcattcgggattacaggttacactttacccctcaaactgtagaattcagtggaatccatggcctttacctctctatagatgacctttttcctacccctttacatctcctgtttttttcctctccaaactgccctaaatttagaggtttattttgaagtaataatcagtcacacacagcaaagtctctcccaacacatggggagcagatgtgctgggattatcactgccatttgaagggtgataaaactgaaggaaaggaatctgactaaagtggcacaggttagaactagcagagtcaggtctagaactcatttcatatttctagaattgtgtgatgatgtactgataaagttttacgatgcccggatctaagtattataatagtgtcaatttctaagttcattttccatcttttacctctcagtggcactcaactaatgttttttgcccccaaaggtcgggtactcacaaaagattccatattctctctggcagtaagggtgagaatgttgctggcagtggtaggagtggcaaggtggccagaggacagggtcctgccattcctcctcagcctccagtaaaccaagtgcaaaagccagagccaattccttctgccacccagcagctaattcactatagggaagacaagtgattgttcaaagggaggttttaaatcataaatcagacacattaattataactttaacaaatgttattaaaagcagcaattaaaaaccatgaatctttttgaaggtgcagagggttataaggtcagttggcagtaatgcagctattatctggtatgaatgaaatgctggggtggggagtcagggtgacctcattaggccttgtgctatcttcccaggtggtgcagacaccccctccctccttttccctctccaggcccacagcctccccagagcccaggtagggaaggtccagatgtactataacaggattgctcatcccaggctatctcagaagtctggaaagcaggcctagaaggttgctgggctctctgaagccaggcaggaagctacaaattggatcccagttcccacagcacccctgggctaggggttggcttctcagctccccttccacctggccctagttggcccctgtggcagcagctgtggggctgaaaagggggaagaactgggtccaacgccagctcgtctatgcctgggctgtgccagggaagcagaggaaagtgggtgggctgtgcacaggaggtgaggtcccccttaaaaggcactgtgggagctgaggtctaagatgggggggcatctaaactatctcagggaccccctgaacgctcacaggtagagaggggtcaggcctagcaatggaaaaacagctcctgcaggcctgctgccccgccagtgcctcttgctgtactaccaccttcgccttcctgctggcggcctgcaaaaccagccaagctggaggccacagcagcagttggcaaggctggtccccatctggtgcccaccctccacgtcaaggcacttttgtccattttccaatcaagtgagtcagtttctaatatctctggaagcagcaaaacatcaggggtcctcttccccctcccaattttggtttccctccagatgaggcagaatttgaatgttggttccaaaaattctctttcaaacccccactggcaagggcttccctttgagggaaccaaatgatgcaggctctttaaaaatttcaacctatcccaaaaagtgattgtccatttcagggcagggcaagggatatgaaagagggtgagtcccctgtgcttccctatgggaccaatgctggttgatgggctgaaagaaggagcggccactgagctttcacatttagttgcagcacctgggccctggaagtgggccaagggaaagccaagggaggagccagcaggcccagagggacggtgtggctctgtgtgtgtacacttgggcatgtggtggtgtggccgtgtggggttgtctgcatgcctagagctgaaagtacaacacatgtggatggaagcttgtgcgagtgggtgtgtattgtctgctgtgtggtgtctggtgggtctggggatgggaggcaccagaaacaggtttagcaagacatggtttccctcccaccactaccaccccccacccccgtcccccaggtttggaaggatgcctccattccagcaaggccaggcccagctctatggcgactgagggggtgaggccagagaacagaagacttctgggacctccaaagctgacattggcagccttcactctcagccttaatacctgggccctggtgctggtgccttctgaggcagacccagccctttactcttcagatcctcacaggctttcacaggggctctctcccatcccaccacctctctccgagggtagtggggagtggcaggaaagtggaagagaaaagcactgagcagcatcctcttatccaccttctcccatgctctctcaaaggtgcctgttatgtagtccctgggaggactggctgccccacgggtcacgtgtgaaggggatccagtggagggacagctgtgcacacacaggatgtgcgaacacacccagaaaggggcgagagaggtcaaggcacacaactggggacaaagacctgggcctcaggaggaagggtcccagcgcaggggacacaaggtcagagaacagataaacagagtttgagggggtgtggagtgtgtagagacacaggcacaggggtaacgagcctgaggaggccctggaacagagctggtacagcagagagacgcaggccttggcctggcaggcaggcaggcagggcattctgccaggcacttgcagctctgtcctgcttccttctcccaccccagcctggagaaagctggggagcctatggcttctgctgctcctcctttggttttcaggacccctggcacccccgggggctagtcagtaaggggtggtcccttcccactccaccaggtactgaaccttgccctcaggtgtgaccctccgagccaacacctggtacttctccccacaggccaaccgcccagctgcaccaaagtagttggtgatagatgacttgaggtgggacagggatgagtcatcttcactgatgctctcaaatgtgtggctgtcaatgccttcgtctggccgctcggggactgaagccccctctgcactgctgtccgaggggcagcgtccatccagctcagctgcccaccgctttgcccgcaggggcatgtatgccttggctgccagcttcctctttcggctgcccactgtccatctgtatcagaagtgggagaggaagatgatgagaatgaggtagaacaatcacagtaaattcctctccctgagtcctcccctcagtaccaggaaagtggaagagaaaagcgctgaacagcattctcttatccatcttctcccatgctctctcaaaggtgcctgttatgtagtccctgagataatctatgccttgggcatagattatctcaccagatcctcacaagagccctgcgaggagggaaactgagggtccagaggagaaaaccaggtagggagtggcagagccaggattcaaacgtaagaacgtccaactccaaagcatatgctcttagagctaggatcccggcactgcaaaagcacaagagcaccattctctgagcctcctgaggccatgcagtgcagaggccctgcttatcccaccttgcctctcaccagactggtggaacaagataggtcacatagggctgggggttagggactgaaggaccctgtaccctagagcctggatggagagactgacagacatcacacacacacacacacacacacacacacacacacacacacacacacgggtgttagagaaatggacacacagacacacaggacaaggcacagattcagatgcttagagacagaaaccaagacctgaagtgctggtgaaaccaaagaaacaggaagaaataggccaggcatggtggtgcacgcctgtagtcccagctactccggaggctgaggcatgagaatcacttgagcctggcaggcggaggttgcagtgagctgagatcatgccactgcactctaatttgggcaacagagtgagactgtctcaaaccaaccaacaaacaggaagaaagaaaaaacaggcaacagcagaggacacctagacagatgtcaagagacacagactccaagacagacctctacaggcattataccattgtcctttttttttttttttttttttgagatggagtcctactctgtcacccagctaattttttttgtatttttagtagaggcggggtttcaccatgttggccaggctgctcttgaactactgacctcaggtaatctgcccaccttggcctcccaaagtgctaggatgacaggcatgagccaccgtgcctggccaggcattatacttttaattctacttttgcaagggcctcaagtatcttaaaatacagtgcagcttgagtgcagaggaaagccctgtgctcgaccactccccgtactgctgaggaccagctgttgccagaccagttgtactggagataggcccccagggatttctgtccccactcctaaatcttccaccctgcaggatgccatcttctgtcaggcttctaaataaacggctctttcccttagagaccccggaagacaggcaccatattcagacagccaagaatcaaggtcagggaactctgtagtccaagaggcagagagacacccaagctcatggcacgtggaggccaaaagtgaaagaaactctggtccaacaaccccagaactggaatcgtccagtgagaggtgtgtacaagcttctgcagcaggtgaagcattccaaagggatggaaccacgggaggctgaatgcctatacttaggtcccatctaaagccccgtgactcagaaccagagggtccgagagccagactcacaattgcagaaggccaggtactccccgccagagactgagacacatagaatgagccacacattacagaagtgggaggtggaggggctgagaggaatgatggtccttgcaaaatgtgaaggccagacctctaggaagctcacctggagtcataggagaggctggtggaggcagagccagaggtgctggcagcgtcggtggagtcgacatctgagaagaaggtctggcctgagctggcactgagaggggcaagaccgtgagcctgctggtggcccggcccagcaagttcctgccaacctggcccgcaggttcccctaacatgcatccttcatcccagtggaggcccgtcttcccacagctgagcttcccaccaccacacctgtctgtttcctacccagccacccttcaaagtccaagaagtcaaaaaaacctcctggagcaccctcccctggcggtgacgtaagcactggtgtcaataactcgagcgtgatccaaggcacctgtgcaacacttcacaggtcaaaagtgctttcatttgcattatcttgtttgaggaaaagagctgaggaggttcagagaggttaagggatttaggtaaaactacatagctagtactgataagcagggtctggagttcaggtctgactctaaagccctcctctgtgtcctcaggaaaatactaaatgacctttaataatttggaaaataaaatgatggaagatgcagttcctcccttggacatacttaagcatggggtgctatggaactacaaaggagggcgtccagcacagcctggggagggttagtaaagccttcctggaagaagcagggtcctgagttttcagatgggctagggcaaggcaaagggtatctcaggcagagggagcaatacgagcaaagatgagcaagcatcaaacagcatggtgagtgtggataaccatggggcaaggtggggagggctggagaagaggggagggctgtggtgctctgggaacagggatgttatgctgaaagctctactgcaaaaagccccttcagacagacctgcacagcagggatccttttaactgagggcttggctttctgcttggttccctccctgtctccagagcagacctctgtgctaggtccctcactgatacctttttaaactttgaatttcatccagcgtgaagtcaaatatgctagccaggtggtggttggtgctccaggctgaggtgaagtcactctgtggacacaggaaggagagaggaagggtcagacagcgagtatcaaatccacctcccacacaggctgcctcctatccagccagggccgctgagggctgggccctccctagggtaagaccatcacctttattccaagtcctgaccagggagccaaagtcatcccagttctagccctgcctttgtctctagctgactgtacgaccttcacgtctctggacctcagttacttcaactgcaaaatggggacaataacccctgccttgcttcactcttacagatgtcaggaagtgcagtaaaattaaataatgcttctaaaccgcaaagtgctgggacatgaggcattgctaatactactgcccacagggagggcttcagggaggtggtggggttactgaaggaggaaagaaagtgctctggaaccctggttccaggctgggctctgccactttgatgtgtggcctcaggaaagtcactgccccacccttccctcagtgtccctacctggacagtggggacaagaatattacctgcctttgccccccaactttggattcctgggagaacttggggggagataaagcaggggtcttagagtgcctggcttagctgtaatagggactggcttctttaagggacatgagagagtcctctgggcctgggggacttagttttcggcacaggaagccctaatatgtgctgaccctgcgtatgaaaatggagagtaagaaaacaaggaactaacactgggaatagcatcttccagcaaaaactttgatctttttcttctataaactcgccttttctgctgctggaattcgtgaggcaacaaactgtggagacagaagagggagaaggtggccccgtcagagcctgagggccctagggtggcccagagggaggcgccgcaggggcgggggtcacagcagttggggagacaggctctgaacacagctgcaccttcacagggaggcctggggaggagggagagtcctcaggagcagtaggggtgggaaggtgtggagaaggtatagtgggcagaaaaagaaaaggtgcctccccaggcacatgcatccagatgccctgccccccagtgccaggatgagggggctcagctgagccaggagagagagggacccctcacacaccctgccttccccttcacctccttgcccaagtcctaatccagcaaggctgggtcctcagatctggcttttcctccttgcgaggtaataagggggctgtggtggtgaaaggagttggggatctgggatctgggatcccgctcagccactatctagccctctcagggtcctacagctgggactggctgggtgcaggtcctccttgcttgcttggaagcagagaaaccgagtttggcggcagccctggcccctgggtccccgagcactgacccaggcttgctctttcctctcttacgcagctcagaggaggcgctgttctcatttggcagcagtcctttgtcaggcagcagcttccctggcgggttgggtgggacgcggatgcgcaggcggaagatgcacttcttcttcttgatctccttgccgcagaggaacctgggggtgggcagtgggaggaagaagctctggagtctgtcagtccatcctcctggggagtggggtcaagcatgacacaagcctctctgcctccttggacccagagctaaaatccggatggtctctgcagatgctgacttcctcaaagcccatgggatgcggggttccaggtagcagctgagaacacggctggtgcctcctccctgtgcttcctcctgcatgagtgtggttcttgctgctcttctcccttttgtttgcctcaaccagccccaaggccacctcctgcaggaagccctcctccagcttacagtggaactcctatggtcaagatactggaatctacttcattctgttctctggtttccccaggagactgaaagcaacaccggctgggctcctctgaggctgcagaagtgacttagacacagccctaccctctttagtacaagaggccacctgccctcccaatagaggactgtccattgggagggcaggtggcctcttgtactgaagagcagagctttgtctgggccctaaaccatgagaatgtggaagagagagtggataattctacccagaggtgtctggaagagtttcagcgatgaggaccttattttattccccaccatgacctcagcacccagacaggcccgacatagaacagcaactcaatgaatacttgttgatggaacgaatgagtaaaaaagactgaggcacatcctagacaaagggcagagcatgagtaaaagtgccaggtaggaaaccaaggactcaggatggctggcacccagaatacagaaagcaaagggacagcggcagaggacgcgggcacagcctggtcttaaaaggccttgagtgccaggttcaggaggctgggcatgcctctgtggtgtagtgagggacatggccagctgtgtgtgctgagaaccctggatgggaagacaggggctgagggatgtcttccacccgaggatgtagcccacccgagatgatgcacccatccctcagtgcctggcccccaaggcctagatgtctagagccggaggggccctcagagagcaggggtgcagcccccctacagagctgagcccagtaccaaaatacggcaggctgctggggtggttggagtggctgtgcaaaggaggtggggtaccccctggatctcggagaatggaaatgattcagagagaaggggagtatcagagaggcagggagcatagcctgagcaaaggctatgaggtaggaaggaatctcacctgtagagggccccaccacactccctcccctccctgcacgcaccggcttttataactgttcagagcgttgaggagatgtggtcctcgatctgtcactggggtgctggtgagctgtgggagagcaggccagcaggacatcagacccaggcatatggcgcatggggaggcccaagcccctactccctcccttccatctcctgatgcttctgagtccttcaggtgaggaccactgactcactccaggatctcagaaaagccttttcacctctccaagttcattcccatttgtaaatggagagaatacttcctgacctaactgtattgagagctttaaaaagtccatacccttgacccagtaatgctactccatggaatctatcatggaatctatatatctgcagatataacacgaaataggaacaaaactttacatacaaaaaaaaatggtggcattgtttctaatggtggacaaatgggaaagaaactgcccaacaggaaggaaacaagtaaactatggtagaaaccaatgcagccatgaaatttggcgggcgcctataatcccagctacttgggaggcggaggcaggagaatcacttgaacccagtgggaggaggttgcagtgagctgagaccgcgccactgcactccagcctgggcgacagagggagactccgtctcaaacaaacaaacaaacaaaaaattttatgaagattctaataatatggaaaagtataatgtatactaaaaaaaagattatttaaaattgtatatactgtatcatttaaacgataaaacagaaaaagatatacatagaagagagtcggaaaggaaatgtacccatgcattagttctagtgatttctgggtggcgtgatatggattttttaaaaagtatacttccttatactttttggtactttaaagattttccaccacgaatatgtacaattaaaaaaaattagaaaaaagttactaaaaaccaactctacgtatcttttaaggttttataatatctatttttttaaaaaaattatcaaatactgtaaatgaagatgttattacatgaaatattttgcaaagcataaaggttattctttttaaattccttttcatcaaagaaagatttggggcagtccatagagaagatgcctcactctgtatgtggtggagaggattctaaggatgtcattagggaaaagaagacacagcacccccgtgggagtgattagggaggccctggctccagctctggctcagcctcaaagctctgctgaccacgggcaagtcactctgcaactctgacattccgaaagtctccgtttgtaatttcactccgtggatctgaggcttccaaggcccttggtgacccactatttagcataggatcagcagtgggcagacccactccatgttgcaacctagccaggaaatctggagtgggtcaaacactcagcagagagctgtgttccagccagacttgatctagggcctcagctcccctccactgaactggggaggccccaacctgcccactgccaaaatctgggattaggaaggcccttaaaggacacaagatcagaggcctggactcagggatgcagcaactcaagggtgagagttcagagacttccatcctagtcctgcactgcgtggccctgggcaaacctctctgcctcctgccactgacatcccacaaccccacataccttgccaagctgcaggagctcccagtggtggttgacaaaggccagaatctcctcaaagtcaaagtacttcttcttgctctgtacccccagattatagagggccaggtgaaccacatccaccctgggcaagggggcaaggaggtgggaccaggtgaggtggcagcctgctcagccagggtcacagctttctgggtccaggctgagagacaggggcagggttgggacccagtagctggaaatggaattgttccaggagggaggagggaggggagaagctgggaggagcagcggtggttggactaagccccaccctctcaccatcgcaggggcagcctctcgatgtactctgggccctggttacacacggagcagaagaacaggtaaaacctgtgggtgggtagagacgggggcctatggtgggaggggctctgacacccccaccccagtccagccccttgatctcctcattccccacctaccttcccataatcttctcactcctaggactgctggccactgggggtcaaggacagggcaggacagggactaagagataccccatattccttctaacccatgccctcaatctccttcccaaatcttgccctgaagcgtggctgagttcacagagagtgagctgagctaggctgggctgccatggtcaccctcttcccctctgagacagccacacacgcaatcacaaatgacatgagacaccaaccaaaagatgcataacatcaggtttgacatccataaggactccattagctttgctccgtcggttagaagccacattaagccatccatttccccagtgactcccacagcaaccctgggcagggctggcgcaaggactgtgtcatcccttcttccccagacacttaagagactagggcatagggaaggcaggcatttatctaaggtactccagaaatcaatggcaactagggatgtggcccagcatacttctttattgcctcctggccctgcatagctaggggatcccctaccttgagctgcctccagtaaacaggtaggcatacattgtcacagacctcctcttgtctggagcctggcagtcaacctgcaggagttgttgctgccatccctgccctctccccaccacgcccaaggcccacttggaccaaattagcacctaccggtctccaaacatcatgggctcattgaggcactgggtgcaggcctcgtggaaccactgcctgcaccggtaacattgcagcatccgcaggtaccatctggagagacagaggagccaaggtcagccaggaccacacccccagtcaggtatgagcttcggcaacctttcccaagttaaatttgccctccactggcagaaagggaagagaattcagttactgagcacttaggctgtgccaagggaggacctgagagttggacatatactctcatttcacctcaccacctggtaaaagatgggacactgtccccatattacagataagtcacaggtgaaatggcttgccctagctcacaggcaagtggaggatggtgattcaaattctggtttccctaacttcagaggctgtgctctccttgccatgccacaatgaagccaccatttctggacttgctgcttcccaaacactgctgacagggaaacgtttgccttggagacttcacgggagaataatggtttctgtaagctgcacgggggcaagactacatctggcttttctcacctgcaactgtatctggcctatcatggtcatccaacaactattcatggaatatgaagagcaaaatgctcaatgcttcattgacaccttgtcaggtgagctccaggttaaaacgcagattccttggtccactgcagacctattcaatctttggggaagcctctgggatgcatttttaacaagcatcctgtgcaactctgcccataggcgttgagaaacactgcattaatgcaggaaaggtttccataagcatttctccatctgacaatacttggggaagctcatgggcctgaagttaaggttaagcccatttgagagatgaagtagttcaagctttgcccaagttacccagctggagcttggggctgagattcaggacttcagggggtcctgacggctgaacttcctgagggcagagaccctccctcttacatctgtggttccttccacaatgccacgtgcactcagcccaaagaagcaagctcaactgccatggctacatagaggcccaggtcggcaaggaagaatcaaagactcttgccgcagagccaggacaagaattccctccacagtggccccgacatagcatgccccgccccccggccccctacccctgcctgattgcacatctccagggaaaagaatcttttctatttttggagacagggtcgtcctgctttgtcgcccaggctggagtacagtggcatgatcacagctcactgcagcctccatctcccaagctcaagtgatcctcccacctcagcctcctacgaagctgggactacaggcgtgtgccaccgcgccaggcgggaaaaggatcttcatatctcaccagcagccggttccactgactctgactgtgaaaaggttatcttgactttcatgcattagtaccaccactaccaccagtaacagctcacattttttttgtttaccaaatgccaggcactatgagaacctctatgtgaattacgtaattcatgctctgctcataatcaccacatgatggggaaactattcagagagctgaggctaaggggttgcacagctggtaaggagcagagctaggacgtggacgtcctgggaggattcgcactgtgtccggcccaggctcttaaccactcttcaatacttcctcgtttcctacaaagctccaaggtaacacctctgccctccagccctgctccacagtgctagatgccacgcggagccggccttctgttctccccttgaggtcccgccccctcgggccccaccccgagcccttcccttcagggaccgccccttgaggcctcgcctcctcaggtcctgttcccgaggccttactattccctcctccccaccccgcccctccacagggtgcttctcgacctgcctcacctccctggggccctgcttgggcggtcgcaacccgccaggcccgcctcccgaggcctcgccccaaggtctaaccttccgggcccgccccccgaggccccgccctcaggtccaatcttccgggcccacccctcgaggccccacctccgcagcggctgacccccccctccccgagtcccgcccccgaggccccacccccgcggctgacactccaggcccgcccctcgaggccccgcccccacagcgcaacacactgggcccgccctcaaggtccccgccttggctgacacgccaggctcgctccctatgggcggtccctgctggcgattcttggagacctgccctgccgcccggggggccctgaccccctgccttactctccgggcccgccgcagtagcagtagcattgctgctggttggtgcgatggggcgagtcccactcgagctcctcgggctggtaggacagcaccatcttcacggcctgcagcgtcctggcgatggcgcccttcttcagcgcgccgcctttctggggggagacgagggccccagtcaaccaccaggtccgggtggaccacgcgagtcagcacgcggctgtctattgagggaagtgctgccagggcttgggggacccgcagatattccaatatagtcagaaaagcaaggagctttttctcattaattccaaacccatcccctctatcccagaaggaactccgttgataacagaattaagagtaataagcgcaataaaggcaacaattaccaacatgtatttacatggattttcttttttaatagtaaagcatcatttattggtcccgttattcccgacaccaaacccatctccactttacagttgaggaaactgaggctcagggagtctacaaatcctggccaaggacagtggcagaggcgctatctgtctccaaagcccaggtgtggcccttctgcttggagctcagactctgtgatgggagtctctggtctgccccactggaggaggcaggagaggcagggactggggaggatggaaggctcacccgcacagccagtgcgaagatgcagcgtcggcagaaccaaggtgtgagcaggggctggtcagcactgcccgctatggggatgtggcactgctggtggtaacctacggcagaggagggggcggtgagcgcccacaaggacatcgtggcccaaggccagttggcccaaaggaggcagggctgggagggctgagggaagtcctaggagctctgcctgccagctgccgggagcctggctgctggtgcccaccaagatggccaagtcagtgtccaggctgggaactaaatgacagcattggccagttgtggggttgggggggacacaggaaggtctgacttcagtgcctgagccccatctttcccacccatcctctccatctagctgggccccaaattacatacaccatcataccctcccagctttccccaggatctcttcccaagccctcacttacagcaactggccccctttcaccctgcagtgccaagagaaacaggaagccagctgaggccccaacaggctgcagcagtacccgtcaggggccagtgcgtggggacctataggtcggggccttctcagggccctgctcgctccactcacccaggccacacttcccgcagatgaggatctcattcagcggccctgatgtcttccctaggcagatgttgcacttgggctcctctcctggaacaccggctgaaagagagggcctcgagggtcgggtccagctcacaggaatggaagttttatactcacattccagatgcccagcctctaatgtctgctaggcctagcgctgggccccacatgccacctcactgaatctccccaaccactctgagatgcctatcatcattaccattcgaaagatggggaaattgaggctctgaaaggttaagtcccttgcttagctagtaagtaggtgagggggggattaaacccatggctgtttgacatcaaaccctttgttcttttgacacatcatgctgcctctcccgccttatttaacttgttttgttaaatggttgttattttcttaaaactttattatgggataatataatttgtttgtttgttttgttgagatggagtctctgtcacccaggctggagtgcagtggtgtgatcttgtctcactgcaacctccgcctccctggttcaagcaattctcctgcctcagcctcccgagtagctgagattgcaggtgcatgccaccacacccagctactttttacatttttagtagagacaggcttttgccatgttggccaggatggtctcgaactcctgacctcaagtgatccacctgccttggcctctcaaagttctgggattacacgcgtgagccactgtgcccagcctagaagttataatgaaactccatcttctcatcacttatgaactcatggccaatctcgtttctactatattcccacctacttctccttcctgtaattattttaaattgagtcccagatacccaatagtttttccataaatatttcagtatgtatttgtgaaagatcaagactctttttaaaaaacataattaaaacacctctactgcacctataagttaacataattgcttaatatcattaacaaattcagttaatgttctcatttccaattgtttcttaagtacaaataccttaacaattttaagtctgttcttttgaatcaaagtccccaagtaaagtccatacatggtgactggctgatgtttttaaaattgcttttagtctacaggtcccctctccatctctttttttctttgcattttattttggttgaagaataaatatgtttttatgtgtgaaaggtttgtatgtatacattaaacacattttgatacgtgtttgtcttatttccccagcatgctgaaaattttgtaagggtagaaatgggatctcttcggccgggcgcagtggctcacgcctgtaatcccagcactttgggaggccgaggcgggcggatcacaaggtcacgagttcgagaccagcctgcccaatagggtgacaccccctctctactaaaaatacaaaaattagctaggcgtggtggcacgtggctgtagtcccagctactcaggaggctgaggcagaagaatcacttgaacctgggaggcagaggttgctgtgagccgagatcaagccactgcactccagcctgggtgacagagcaagactctgtctcaaaaaaaaaaaaaaaaaaaaaaaaaaaaaaagaaatggtacctcttcatctctgtatccccaggacctcatagagtgtggcatgtaacaggtgttccaagacgtttgttgaatatatggccaggcaggaacgttgcctcctattcttgaacatgctcccaggaaggtggtgcccacagtgcatctcagtaagtcctcactgggttaatgaagcaatggatcaataactacagtggtgctcagccttatgctctcatctcaggagatgctagagggtcaccattctgcccggaaggggcagttctggctaggagacaagccactcttcagctgatcactgtgggtacctccaaggagcctggtatgtggtgggcctccacaggaggtcagctaaggtgcatggtcttctccatctggctccttatgctttcaataagggggtaaaccaggagaggagatcctcattgctttggatatttatataatactatttcaggggttggagaggaatcggtctgcactggccacaatttcttggagaagggggcaattcgaaagctttactaactggctgagttctgcagcctcttcttggcaggcttcttggaatcatctcttattgtaacaaattctttttttttctttttcttttcttttttttttttttgagacagagtctcgctctgttgcccaggctggagtgcagtggtgtgatctcagctcactgcaacctcctgcctcagcctcccgggtagctgtatttttagtagagacagggttttactgtgttggtcaggccagtctcaaactcctgacgtcaggcgattcacccaccttggcctcccaaagtgctgggattacaggtatgagccactgcgcctggctggtaacaaattcttgagtaacagcttctctaaaaccaatagtactgagctaagcattttacatggattagcttacctaagcctcccaaccaccctatgaagccagtactttcactatcacctctcacatgaagaaactaaaactcaggtcatattacttgctcctgcaaatgcagctagtaagtggcaaagctggaacttggtccaaggtctacctgaccctaaaatctgcttcttaccctgctaggggccatgtctcttctcctgttagagtataaatggcaaacaggtttctcctcttatgccaactctgattgacaggcagtagctgcttggggctccaagttgaaagtacatgtgttgtcaatggctactgatgtctgttgtgtgtatgggaagggagaatggtggcaaagatggccctgacttgccatctctgcaagggagagatgtcagctttctgaaggcagggatgatacccaacccagattcatttcagccctaaaagctggtctagctccatccaggcatgtccatcttcaccctgcctggctcacctctgctttattggtttttctcccattcctcccaactccttgccccgtggagaaggctgcttccattagttttattcatatgttaaatcagggacactgtgcttgcatctagagctgacaattctgaatacctgggcacgcccccttttctagcccagactgacgcagagctttgagcagctgcagctgtagtgcagccaggaagcaaacgcaggcctgaggcccagtcctggccctcccagcacctccctaagctaccttccccacctgcccatcctccctcctggggtatgaattctcaaggggatgactcatgtcctaagtaccttcctaagtcaatatacaaccagatttgatcatcatcacaggtgggcttggggttcatggtcaagggcagatgccaggagtaagagatggaaggacagaaggaagaaatgaaggcagcagaggagagaagacctggggaggttgggggctacccgaaatgttaggaaaactcaccatgctgtatgtccttccataggacccagtatttggaattatcttcgaaagtcacgaggcagctttgcttagagctgctgacctggggtacagataggaaggagcaagtgagaaagggctggggaaaagccaacctggaacatagtcttcctcccccatttttgtctccgtatgttccagaaagcagggctagaaggggaagaaggatggcagttcctggacagggtgtactcctagtcacctggagtcgtacagccagggaccgatggatggcaacttggtcagaatgttgaggacagaagcacaagtcagatgctcctctgtgatcctctcaaacctgacttttttgttttgtaggctctcagagcacttttctaaagaactagttggatgatgttgaccctagggatggtgcctgcaagaccaggctctggcccctcccaccaccagctttgggcatgagggacaagaagggaattctccagcaatccccctgccccctggtctgacagccaggctggaacatgagcagagagattctgagtctgagaacaggggccagagaggatgggtttaccctcttgatcttcccgaggtagtacaggccatctgtccaccggcacagcacatactggccctccgtcagtttggacatcaagtctttgaagttgttcttgaccttcgccagggcccccttgttggggaggtggctggtggcaccataggagtcccgagtccctggatccagagctcgattctccatcagcttcccctgacactgggagagaaagaacagggtttttgcttcttgcttccctgcttcagaaagcccatcaggggaaggaaggaaaccaccatttctgtaccctgtgctataagccagacttggttattatctcactgattcctcgtgaccatcctatgagggagacattattattattcacatcttacagatagggaaacaggtgtggcaaggagaagaggctgatgggccaaaggcagagccatggcccataccacactaccttttaaagagaatggatctctcaacccacacagaacaaagtcccctacccagcgggcctgaaccactccctgtctcaggaggctgaggttttattccttaagcaaacacagtccatgtgctctggatggaggatcttctccaggcaagcagttgggttttgtttttacccccaacccctgcaaccatccctaacctgagatctgtccagagaaaattcacctagaaaggaaaactgggtggcttgtagctagtgtagactgggtcatctgtcttttgtaatccccccttctgttctcaattatgagatgatttaatggaaaccaattctgggacatttaaacccacttatgctttcacccagatacacatttgctccaagcagtgaagtcatccatccccatgccagcctctccacgcctgtctctcaccatcctattcaacgtgcagttcacccatcgatttctctctccctgcctgtggtactgccttcatgcatctcaaactcctccaagcaattagttgccacagccggcccattttaagtgccatgatttctggctttccagctctagcttccatcctcctgccctggtctcagttcaggcctcatcttttgcttgggccattcattcattcattcattcacccaataacagtttcctgggccttgtgcttacctccactaggcacctagggtggggaacggtactaccagcacccagtgctaaacaggccgttcctgcattcctgcctctccaccagactcttccgcagggccaccaatttccttccagaaactttctggggctccccactgccctcactggtgctcaaagccgtccctaacgccccctcctttctgctgggctcacctggctccaagtccctccacatgctctccactacagccacacacagcctctctctttccccgcgggcctactcgggtctcctccttgtggccatggcgctgggcacctggtgttgtgactatctgttcacagggagagagtccagtgcctgtttctgtgtggtgcgtgtgtgtactcctgtgagactgggcaggatgatgtctacggcattgtgccagggagtgtgtgaagctaagtatgtgcggggccctggggcgagccaggcactgcaggggtctcggctccccagatggtggcgtggccacgaccttctccacccccactcccatctcctttttctccagcgcagagcgcacaggctcccgggcaggggatgcggtctgaatccctgtcctctccctgccacctggctcgcccggcgctgcgaggtccccgcccgcccggccaggggccaggccggggccgctgcaggttcacaaactgacacttcctctcccgctgcgcctctaggagccggccgggtcgccgcacccgcctccaccctggccgggcgggggcccccgggtggcgcccccccagcccccgcctccgtcctcccggagcgggcccccgcgggctgtgattggctgattcaaacccatttgcaaagaaatgcctgtttgcgggttcccgtctgcgtccagttcaaatccgcggcaccgggagcgcggggccgggcgggggcaggaagcgaggatgattcatgcgccggggcctctcccagggcggccgttggctttttaaaaaggatgttcaggaggggggaaaaagcttgcagaagcacccccttcgggttcagcgctcctctcctcagtcgctcggacgccaagcctcccccatcccaaccctgccgcagcctgacttcggacgtgagcgaaatgccaaacgcccgtctgtccttcccccaccccgataggaaaattaaagatcgggggcgaggaagaacgacctgtcacccatgccccccggggctcgggaacccgggtggggcccctctgccccgcaggtaacctgcacccccggtccccacccccgagagccccgctccgcaggagtctcaccccccggaggcgttcgggccgccaaagttcagggagatttcgaaaagagagggatgagggccgggaggggagagcgtggcggggagtccgcccaacagcgcagaactcaccgcgaggctgcgtgtccgccggtcccacttggagtctggccaccaggcgcatcggtggcggaggcggctgcgctcggcccgcggctgcccggccgagtgtccgcccgtggggccggggtcggggtctcggcgggggcggggcggggcgggggcgccgcggggaggagggggaggcggcggagggaggggccggggcgctcaggaaggggccccccgggcgcggggcgccatctttttcgcgttttcccgcgaattattgacgtcccgcttatgtaattagcgggggccgcgccggcctcgccattggagcccgcggccgccgggctccgcagcgccgccagcccccgcccgcccccgcccgccccgcgggcgcgcatcctccgcggccactagccaggacccgggccccccgccgaggagcggccacaccgcggcgcacacggagacgccaggcagcgctcatggcgcacacgaccgctcgcacacttgttgaggaaacacagctctgcgcgcaggcaccggcggaccctggcacagacacacagcagggcggcgcggacccttggcgcagacacagacccaggacgcccaaacaggccacacaacaccttgcactaacagcacaggcgttcggcacagagacacagcacaagtataatgtagatacacaacacacagtgcacaacgcatgttgttccgacacaggtcagaacacaccacagcatgtacaggacacaaacacaccacaaagagaagtactgtacacaccagccataggcatagatacacaagggggaacacactgtacacaacagagacacacaacagaacatgcatgtaaggtagacggacataacacataaagtcacaacacagacgggcaagagacacaagttttcctgaaaaagtggcattcagataggttgtggaaataggttagtgggtgtgccaggtggagggaattcagtgggctaacaatgcaatttttaaaatacgggttaaggatatcaaaaggcaattcacaaaagaggaaacctacatggccgaaatagccccaaacaacaaattgcgtagagacacagtgcacagaaatacatggtacaatcgcaaatatataccacacgcacaacatgtcatgtaaataaagggcacacaatgaaagacaacatgcacagagtcataggaatggcagatggagtcagtgggcagagctccaatcatagggaccctgccctgtgggggaaaggcagacatggccccacccagactcactcttgggggaagggaggaagaacacttaccaataaccccacccccatccttgccctcagtccacagcgcccacctctgtggctaccatcccactctgcagacacccccaccagacagggatatgtgctttcatgggtgtggccagtggacagcaccttcccccagagccttccctgttcactgtcagttgctcactctgggccctctgcctcctggccttggagcatgatctgtgcagccccccacctcaccttctcagcagagatccaggagtcctttcacctccttcctcacttccttctgccccttgatccccctgctctcacctgcctcactgccccattctggatcctggcgcctcagcagaacctagcactgctgagtacctgcctgaacctggaaggaaagcctgggagcagccccatggcacaaaatctcccaatcctggagagcacattttcaagtcccaaaggggccctaggattgtgctacttaaccatgttctgccaagagaaggtgtgtccaacgcgggtagggctgatgatgggagcagaacactcccactagcttctaagctggctgggtctgccttcaggatgctgggggacagagatgatagagcgaagtgctcacctctgaggctacaggccagctccacccattactggccatgggagcctgagtgtgtcacttctttctttcttttttttttaaacaattcttgctccagagactttaagtcttaagcctccgtgtcctcacctaaatagagttattgggaaggttagagttaatgtatgcaaagcccctggtgcccagtaggtgtgcagtaagtgatcattgtattaatactttgttaagaaattctgtattcagaatcttgattgccccactgtgtgggactagagcggggggatgtgagacacacaggtggatgggagacacacaggtggatgagagacaaggaactggcaacctcgtggaggaggcggtgttgatgcatagataaataagaggggattgtgctgtgagctgcacgtggaattgaattgtcctggcttcaagtccagctctgcctctgagccagggcggggtcttgggttagctagaccctcctacaccatgtttctttatcggttgaaaagagggtaataatactacccatctcgtggggctgttgcataaatgttcaaataagacaatgaaggagcaggtgcttttgtaaactaaaaagtttgatatgcaaaataagaagttaaaacactacagaacaggaaattataaatgccacaagaaaggtacggtgtcaccagtgattatttagaggcaactctaaattcgaattgaggaaagagaacaagtttcccggaaaaagtagcaatcagttaggttgtggaaatagggaggtgggtgtgccaggtggagggagtttaatgggctgaccaacaatccaattttttaaatatggattaaggatatcaacaggcaactcacaaaagaggaaacctaaatggctaaaatagcctaaaatgtgaaaaggtgctcaaccttattggccacgtgagagacgcaaatgaagagaactgtgatacaccattacacatccaccagatgggcacggagtcgagtctgtcaatataggggggtggggggtgaggatgtcgcacagttgggaccctcaaatacctatggagatatgaactggtaaaacgattttggagaacagtttggcaacttgtaagaaagtggaagatactcatagctacaattcaatgactccactcgtcattcagcgcataattgtgaaaatttagaaattaatgaattatccatgaacagcagtccagataggccaggcactgtggctcatgcctgtaatcccagcactttgggaggccaaggcaggtggatcacttgaggtcaggagtttgagaccagcctgatcaatatggtgaaatcccgtctctactaaaaatacaaaaattagccgggcatggtggcgtgtgcctgtagtcccagctacttgggaggctgagacaggagaattgtttgaacctgggaggtggaggttgcattgagcgaaatcgtgccactgcactccagcctgagtgactgagcgagactccgtctcaacaaacaaacagcagaccagatagattaattgtgatgtagtcatacaatggaataatatactgggagtaaaaataaactaagtctgcagcctcaacatagttacaccctaggaaaaaaactaacatcaagttgtagcataggtacagtgtgacacaaatgataaaaaatgtttcttaacgcattcagctgggcccgtggctcaagtctgtattccagcgctttgggaggctatggtgggaagatcgcttgagcccaggagttcaagaccagcctgggcaacatggcgaaaccctatctctactaaaaatacaaaaattagctgggcatgatggcatgcacctgtagtcccagctacttgggagactgaggtgggaagattgattgagcccaggagtttgaggccacagtaagccatgattgtgccactgcactccagcctgggtgacagagagagactttctcaaaaacaaacaaacaaacaacaaaaaacccaaagaaatacaaaataagctatgtagacattttggggctacagtcagctagtaaaagtattgaaacatgcatgggaaatcaaagaccctagatttagaatagggtaacctttgggaagggagggacaggaatgagatcagaaggaagcacatcgggggtttgttttttttttttttttttgagagagtctcgctctgttgcccaggctggagtgcagtggcgcgatctcggctcactgcaacctccgcctcccgggttcacgcccttctcctgcctcagcctcccgagtagctgggactacaggcacccaccaccacgccccgctgattttttatatttttagtagagacgggctttcaccgtgttagccaagatggtcttgatctcctgacctcgtgatccgcccacttctgcctcccaaagtgctgggattacaggcgtgagtcaccgtgcctggcccacagggggtttaattctatctgtatgttttatttcttagaaaaaaaaattaaaatctgaggcaagtatgaccaagtgtcaagatgtaacagagctgggtggttgatccatagttgttctctctgatccttctccttctcaagtctaaaacttttccatgtttgagatatttggtgattttaaaggtgggaggggcaggaagctatgaggagattgcagcagaggaggttttgatgatagcattgcttgttaggtgtccagggtggttacagtgcacagtgtcccctcatgcatgggactgatcacccttcttatttgtttgtttgtttatttgagatgaagtcttgctctgttgcctaggccagagtgcagtggcacgatctcggctcactgcaaactctgcctcccaggttcaagcaattctcctgcctcagcctcctgggtagccggggttccaggtgcacgctatcacgcctggctaatttttgtatttttagtagagattgggtttcaccatgttggtcaggctggtcttgaactcctgacttcatgatccaccagccttggccttccaaagtgttgggattacaggtgcgtgccactgcacctggcccacccttctcttttaaggcttgtcacagcgtggtgagccaggtgtggcaggcatcaggtccattttgcaggggatgaaatggaggtttggaaaggcgtagtgataaactcagtgtcacacacaatagagagtcagggcttgtcccctctgctcagcagtgtctcagtacctctctgtccagggagaccaccaaagggccagagagccctgagagaaggttccctgcctcccagtgatccatcctcttccttctgctgtgctattctatgttttctttcaattaaggacaatttggaaaatgtcaaaaagcacgaggaagaaaataaaagtaacttgtgattttcactgttacttttaaaatcagatttatcgaaatatacttcacgtatgacaaattcacttacttaaaatatacagtcattattttgagagaacatcattttctttcagaaatacttatttgaataccaaacaagttagcctatatgaaagtgctctacagccaggcacagtggctcatgcctgtaatcccagcactttgagaggctgaggtgggcggatcacctgaggtccggagttcaagaccagcctggccaacatgatgaaaccccatctttactaaaaatacaaaaattagtcgtgcatggtggcggccacctgtaatcccagctacttgggaggctgaggcaggagaatctcttgagcccagaaggcgtaggttgcagtgagccgatattgtgccattgcactccagcctgggtgacaagagcaaaactccatctcaaaaaaaaaaaaaaaaagaaagaaactgctctacacacaagaggcttttcacaaatatgaataattattattacataatttttggaagtaattattatgcaggtgaccagttagacgagcccatgttttatggcctgaatttcggggttggtttatcatgtcctcagcatggaggtgtagagagttttcagattacagtagaaagcacggttattaacaccagttttaaaaaaaatggttgccagggtcagactgtgacctgttggcatgcctgtggccttggttagctgccaaactataaacacctttacctgtggcttttgtggggaaatgagagaagtctgcctgccttctctgtgaacccagggggtgtagaaaagaaaggggagccttcaccagacactggagatcctatttccctgccttgccagcttgctgtggaaccaaggatcccttcccttgtctaaattttagtctccccatctgttaaagataaagtggtggtttgttcaccctttcaacatagtgcacatgtgtagcgaaccatgctgtaggcaggcaccatgctaggaatgacaggcgtggcatgaagatgaataagatgcagcctttgatctcaggaagctcccggtccagccgggcacggtggctcatgcctgaaatcccagcactttgggaggctgaggtgggtgaattgcctgagctccggagttcgagcccagcctgggcaacttggtgaaatcccatctctaccaaaaatacaaagaattagctgggcatggtggcatgcacctgtggtcctagctacttgggagcctgaggtgggaggatcacttgagcctggaggcagaggttgcagtgagctgagatcacaccgtgcactccagcagcctgggtgacagaacaagacactgtctccaaaaaaaaaaaaaaaaaaaatagaagctcctggtccagagctagggggtggggctagggggacagacagattgatagataattgtgggagggtgtcgagacaaggagtgatcaggacaaggagggtcagaccacaatgacctctaagttgcctctgatggcaaaattatttgattctatgaactcagtctaagctttgtttctccctcactcggtaacctaggatgggtcacttctctaatcagggcttcagatggactcactggtcaatatatgaagtctagaacaaatgagttgctcccagtcattctttataaaggttgttatataaagatttgacccaccaaaagctgcattgactatttgcgagatattttgtcttcttgttttttatcaattaggtctacatactacattcaattagagattttgattgatatgattaaaacagtgtgatcataaaagactgactcagatatagttaattaaagatacctttaaagttttccccacgttaaaatacagaggtgtcattttattaatgaactccagtatttacaaggcatcctttctggaatcaagcaatccatgagtcgatccgcgtgaggtggatgagctcctggccccaagctgggtgtgtaggagaaagaggaaatgtatgagatgagagctgctccccgggagccaaggctcttgctgggcatttcatgaaggagacaagatataaccaactgcccaagatatagccagaggagagcaaataagaagatagtggatacaacagggtcatttgtatgattcaactagtattggtggaactgaggtttgaacccaggtgatatggtgtattcaaaagctaatgccagtctgggcacggtggctcacacctgtaatgccagcactttgggaggctgaggtgggcggatcaccagaggccaggagtttgagaccagcctggccaacatggtgaaaccagatctctaccaaaaaatacaaaaaaaaaaaaaaaaattagctggatgtggtggtacacgcctatgatcccagctactccagaggccgaggcatgagaatcacttcaaccctggaggcagaagttgcagtgagttcagatagcaccactgcactctggcctaggagcgagactctgtctaaaaaaataaaaataaaaattaaaaaaagccaataccagccactcatgtaaatcccaactacttaggaggttgaggtgggagaatcatttgaggccaggagttcaagaccagcctgggcaacatagcaagaccacatctctaaaaataaaaataaattagctggggtggtgacatgcacctgcagcgccaactactcaggaggctgaagtaggaggattgcttgaacccagaagttcgaggatgcagtaagctatgattacatcactgcactccagtctgagcaacagagtgagaccctgtgtcttaatggagggaaccttccaagtcaagttttccaacttctcattttcagatggggaaacggatatctagaaagcaggagaggttcggcgcagtggttcacgcctgtaatcctagcactttgggaggccgaggcgggcagatcatgaggtcaaaagtttgagaccagcctggccaacatggtgaaacctcgtctctactaaaagtacaaaaatgagctgggcatggtgatgtgcgcctgtaatcccagctactgggaatgctgaggcaggagaatggcttgaacccaggaggcggaggttgcagtgagccgatatcatgccactgcactccagcctgggtgacagagcaagactctatcttggaaaaaaaaaaaaaaaaacaaagcaggagaggtctggccaaagtcctgcaggaaagacgcattcaagatgaagtagtaaatcagcacatgagccataagtgggtccaggcctctgcccctcccttgcccagagatgtatgccatgccacttttgtcaggtccccagcagtcctcttgagttttttaattgccaaaatttattttaaaatccttctgtttgagtgttccatgacatgtgaccttcttatgagtttcagaggtaatccctgcctgggtggaggaatacctaagtgaccttcaggacctctttcagcttggagaagcggaaattctgttgccagaattccatggctctttaaagctaatcttcactcttttacagctctcagaaggaactctcacgtctggcctttctctgttgtctgttctgctccctgatcttcggcttaagttggggcaatagttccaagaggtttagctgggaccattcagatctgtgtcttatagctgcttcttccaagattacaattcaaagtcccagatgcctccccctgcagaggagaggaaacatctgggctggagctgcacggagagagcccagctgtgtgggacatccctcagggtaggagcctgtgagctgagagctcttcattgcagatgtggttctaaccatcggggtctgggtctcacccatgaggcttcgacaggccccaggcatgtgtgtgcagggaatctgaacagtcagcctgcaggaaagaggctctggggagttatatgtggctggtgtggtggcaagtagagtttgtatggacaccgaaccaaaatagagaaatgcgaaggcagctagacagaaagtgggtggggggaagcattccaaggaacagacctctgcagcaaggagcttggtctgtgcaggtcacagggaaagcaaagaaaaacataggctcaaaccacgagtcatttattcactcatccttcacggctaaccacagcatttagccatgcactcctggtgtgactatggagatcccttccacagccagatgacccaatgtcagctggagtgtttcccactccaacggctggttcatccagcctgtagtcaccgccctctggcagaggcaccactctgggctgacccctctgtgatggtcaattttatatgtccacatgactaagctatcatacctagttatttaatccaacatcaatctaggtgtcgctgtcaaggcatcttagagatgtggttaacatttatcatcagttgactttaagaaaaattccctcgagaccagcctggccagtatggtgaaaccctgtctctactaaaaatacaaaaaaattagccgggtgtgattgcacacacctatacagctacccgggaggctgaggcaggagaattgcttgaacctgggagatggaggttgcaatgaggcgagatcgccccactgcactccagcctaggtgacagagccagactctgtctaaaaaaaaaaaaagaaaagaaaagaaaagaaaaaagaaaattaccctcgatagagtgagtaggccacagccaatcagtggaaggccttaagagtaaaaacaggtttctggctgggtgcggtggctcacatctataatcccagctctttgggaggccaaggtgggcggatcacctgaggtcaggatttcaagaccagcctggccaacatggtgaaatcctgtctctactaaaaatgcaaaattagccagtcgtggtggcgcgtgc

SEQ ID NO: 84 - DNA, 46876 bp, Homo sapiens
tctcagctcactgcaacctccacctcccaggttcaagcaattctcctgcctcagcctcccaagtagctgagattacaggcatgcgtcagcacacccagctaatttttatatttttagtagagatggggtttcgccatgttgatcaggctggatagtcttgaactcctgatcttgggtgatccatccgcctcggcctcccaaagtgctggtattacaggcgtgagccactgtgcctggccagtttgttcttttattttttattttttattttgtttaatttttttgaggcagagtctcactctgtcacccaggctggagtgcaatggcacgatctcagctcactgcaagctccgcctcccgggtacccgccattctcctgcctcagcctcccgagcagctgggactacaggcgcccgccaccatgctcagctaattttttgtgtatttttagtagagatggggtttcactgtgttagccaggatgatctcgatctcctgacctcatgatccacccgcctcggcctcccaaagtgctgggattacaggcatgagccactgcacccggccattcttctttcatagtttccttgagatgtaatgttaggttgttaatttgtgatatttctttccttttgatgtaggcatttagtaccatgaacttcccttttagaactgcttttgatgtatcttacaagtcttcatttgtcacaagatatttttaaatttcccttttaatttatttgacccaacatttgttcaggagcatattattttatttccaagtatttattcattttccttgatttctcctgttactgatgtctagtttcgtaccaatatggtcacaaaagatacttaatatgatttcaatcttcttaaatttttaaagacttttctatgggctaacatgatgtatcctggataatgtgatgtgtgtgcttgagaagaatgtgtattctattgcttttggatataatgttttgtatatttctgttagatccattttgtctaaagtgtagctcaagtccagtgttttcttattgattttctgtttgaatgatctgtctattgttaaaaatgaagtattgaatccctactactattgtgttatagtctctctactataggctttgctctgtaattaccctgaggcttacataaaacaccttactacaggctattttaagttgacaacaacttaattttcattttaatgtcatactcaaactgtatgcttttattccccctcctctcatgttttatgcttttgatgccacacttcatacctttttataatttgtatcctttaaccagttattatagctttagttgtttttaatagttttgcatttaatctttatactatatactttaatctttatactttataccagagatataattcattgcccactgccactgcagaaatagagaatttggatttgacaatgtgcttactttttccagtgacttttatattttcatatgttcttatgttactgcttagcatcctcttccttcagcttgaagaactccctttagcattttttgtaaggcaggcctagtggtgacagactctctcaatttttgtttaagtctttatcaccctttcatttttgaaagacaggattatttgatatagtattcttggtcagcaggtttgttttttttttccttttaggattttgaatataccattccattcctttcttgactgcaaggtttctgaagataaatctgctgatagtcttatatatgttccattgtatgtgacaatttgctttttccttgctgctttcagcactttcactttgtctttaacttttgacaatttgattatgatgtgtcttgatgtgggtctctttggatttatcatttgctgtactttgggcttcttggatctggcttttaatttcctttcctagacttggaaagttttctgtcattgtttctttgaatatattctctatgcttttctttttctccctctccttcttctggtacactaacaatgcataagtttttcaatagatgttgttccataagtctcttaaattatctacattccttaattttttaatttttgctcccagattgaatgatttccagtgacctgtcttcaagttcattggtcctttcttctgcttgatctggtctgctgttgaacccctctattgaatttttcagtttagttatagtattcttcagatttgtaatttctgtttggtacttttttatactttctttttgttgaaattcccagtttgttcttatattgacctcttgactttggagagcatctttattactattattattatcattattattattattattattattgagacagagtccactctgttgcccaggctgaagtgcagtggtatgatcttggctcactacagcctccacctcctggtttcaagtgattcttgtgcctcggcctccaaagtagctgggactacagtcatgtgccaccacacctggctattttttttctatttttagtagagatgggtttccaccatgttggacaggctggtctcaaactcctggcttcaagtcatctactcacctcagcttcccacagtgctagggttacaggcatgagccactactagcagcctatcaccattattttgaattgctgtcaggtcaaacaatatctcccattcgtttgggttagtttctgtagaattatcttgctcttttatttgtttcttcatttcccttgactctctgtgttggtttctgtgcattagataagacaaataactcgtccagtattgtgaggctggccttatataggagaagaatctcacctatctgtccagccacccgccttggcctcccaaagtgctgggattacaggtgtgagccaccatgtcctgcctacagtataagttctttcatgtttttgaaagaaactggaacaaaagattttatcatattttttatattcataggatttttctcaagtgtgaatctgtttatgtttttgaaggtacctgatatatctgaatgctttccttattccttacaaggaacaggttttctatgcagtttgagttatttcatgtatttgacagaaactggaaaggccacatttttttaatgctcataggatccttctccatttttaatctattcatgtgttggaaaggaactgggataattaaatgctttcctacattcctttccttcattggatgtctttgtttttttgttttttgtttttgtttttttttttgagacagagtttcactctgtcacccaggatagagtgcagcggctcattgcagccttgagctcttgggctcaagcagtcctcttgcctctgtcttttggttagctaggacaacaggtgtgtaccaccatgcctggctgatttttcattatttttggaacagatgaggtctcactacgttgcccaggctggtctcgaactcctgtacttaagtgaccctcctgcctcggcctccctgagtgctggaattagaggcatgagccactgcacctggcctctattgcacttttcattgcattcattgtattttttcaattccagaatctttttaatccaactgaatatatttattacaagtgcattgagactatacagaatcatggttaagaacacagactgtgtagtcagactgcttcgattcaaagcccagctctgcccagctgtgtaaccttgggcaattttcttaacctctctgtgcagtcattgcctcgactgtgaaatggggtaaaaataatatgtggctcatagggttcttaacggagttcaatgagttaaaatatgttcagcagttagaactcatagtaagtaccatatatatttatgctattattttcatgttgctacttatctgtcatacacaaaaggtaatttttccccctttttaactgacatgtaataattatacatatttatgagataaagaatgatattttgacgcatgtatacaatgcataatcagcaaatgagactagtttccgtatctatcacctgaaaaatttgtcatttccttgtgttgggaatgttcaaaattttctcttctagattttgaacatacacagtaaattattgtcagtaatattcaccctacagtgctatatagaacactaacttattcctcctatctcgttgtaattttgtatctgttaaccaacctctctatgtccttgcttcccagcctttaataaccataattctttttcaattcaattttttttttttttgagaccgagtctcgctctgtcgcccaggctggagtgcaatggcatgatctcggctcactgcaacctccacctcccaggttcaagcaattcttctgtctcagcctcctgagtaggtgggattacaggcagctgccatcatgcccggctaatttttgtatttttgtagagatggggtttcaccatgttgcccaggctggtcttgaactcctgacctcaggtgatccacccgcctcagcctcccaaagtgctgggattacaggcatgagccactgcgcctggctcataattcttctatttctataagctcaattttgtgctccttcccacaattgaatgagaacatgtggtatttatctttctgtgcctgagttatttcacttaacataatgtcctccaggctaatccatgttgctgaaaatgacaaggatttgtatccttttttatggctgaataatatttcactgtgtatatatatatcacattttccttttccattcatctgttagtggacatttaggttgattccatatcttagctattgtgaatagtgctgcaatatacatgagggtgcaggtatccttttgatgtactgatttgatgtacatcagtacatcaaatacccaacagctgtaaatacccaacagcaggattgctggatcatatggtagttctatttttagtttttttcagaacctttcagactattttccataatggctgtactaatttacttcctacgatagtgcattccctttttttctgcatccttgctagcatttattattttttgttcttttgataatagccattataactggggtgagatgatatttcattatggttttactttgcatttcctggacgcttattgcagttcctgaatttctggatttttaaaaaataatttcagtctctgttaaatttcttattttgatcacttccccccaatttcgtgaattgtttctctatatcttcttgcagtttgctcagctctcttaaaagaaatattttgaattctttgtcaggtaatttgttacctttgtttctttggggtcagctactgggagatgattgtgttctttggttgatgttatgtctccttgttttgtcatatttcttgttgcttttatggtaatgtatgcacatgagatggaacagtcacctcctccagaatttataggctagtttcactatgtaaagatcttcccctgtgtaggggtggcaagggcacttgctgagtggggtgcagtgagtgatgccaattctcagctatgccaatgttaccagcagtcctttctatattctctgtattttttgcttcattgtgttgctgaagatttttttttttttttttgagacagggtatctgtcacccaggctggagtgtagtgcatgatcatggctcactgtagcctcaacttccagggctccagcaatcctcctgcctcagcctcctaagtagctgggaccacaggtgtgtgccaccatgccaggctaattaattttttttttttttactacagggtcttgctatgtagcccaggttagtttgctgcagattctttaatgaacccttcagatcttttgggctagtttggtttgtaaatagctgtctatatttgtttgtttttgtgttttgttttttgtggaaggctgaaggttggtaactcctatcctgccatcttggtgacctcccctctcaggctctttcaagatgttctcttcatggtctctctttttttttttttttttccttagggctagagaatatgtttatacgcttccacattaggttcagatgcccatgccacatatggcttatggggtgtctctgatgtttcaactcattttcaagtatttgattctagcaccttttcacaagcctgtagagcacaaacaggctttccctatatgtcatcatatttcaatagtgctttattaaaggacagatgaatatgcagctttattgggaaatgtttacaaatatcagaaaggactaatcaagcatcctatataaaactttccaaacctctgaggatgcctgtgaaggaggacaaagtatactatacccagaaatcttagtacattcaagtatctgatatttgcttggggataatctaatcattctacacacatacaccaagattggtcattctgtcagggcatgttctcaggaggggctgagcaacttgtgggcagcaggctctcactagtgtacattccaactgaaccctcagctccagaaatggtgctacatggggcctggacttcctaacatctgggtgtccatgaacatatggtcactcttcctcctcttgcgtccacctggaagccatctacatccccagctccaatctgcctttcatggctgtgcttattcatgaattttgtgatacacatgctgcctgggggcctccttttcagaagatgggtgtctcctagttgggccatggcaggaacaccaccactgtcctcactgggggccatcttttctgttctctgaagctcagggaggttgaagactaacagaacttgaatgagagacaccctgataatattagctcccatttgcttttcccacccccctccaccaagaatcagccagatatttctctcttctctgtccctgcctcccagttcctcacatctgttaccctcagatgcccttggtacctggtgtgatataggcgggcagtggtatcctagccctgagcacttgtggcacctacactacactggggtgaccaggcagcaggatcccacccttcgaccggagaaaaaggctcccatcatcctctgactctgccagccacgacagagccctaaaatccacaggtgcatcccaaaggtccaaaccaccttctgtgcctaacttattgccctggtgaagtagattcaagtattcaatacctgtttgaggataacctaatcatcctacatacatacacctgagtttgtcagtctgccagggatactccctgtagaccttctcccatcagacttatatgacagggactgaccaagggaagaaagggcccttatacacagaatacattgtggaaaaaaagtgtgtgtgtgtgtgtgtgtgtgtgtgtgtgtgtgcttacatatctataaccaagaaaaatgtaaccaagtcttattttgctttataattagtggacttttaaaaatcattctatggtactgttatgactcagtgatggcagcagtgactcagtgatggtggtgaatgctcagaattaaaaggaaaaccttaaataggggaatttttgtaataaaatgttattcttggctgggcgcggcagctcatgcctgtaatcccagcactttgggaggctgaggcaggcatatcacctgaggttgggcattcgagaccagcctggccaacgcggtaaaaccctgtctctactaaaaatacaaaaattagccgggcatggtggcgcacgtctgtaatcccagctagtcacgaggctgagatgcgaaaatcgcttgaaccccagaggcggaagttgcagtgagccaagatcgtaccactgtactccagcctgggtgacagagcaagactctgtctcaaaaaaaaaaaaaaaaaagtttcttgtctgcaagcaggaaacattttagtaatctgggtggtagaactgcaagtaatgtgaatctattagccctctagtttatattagcttaaaacttcactagtgtaaagagttggatgtctaacttttgtcaagttctacttaggcagtatttcacagatgggtgcaacaaattcacatttcatgtcatgaaatataccctatattcatttcctagggacactataataaagtatcacaaactgggtgacttaaaacagcaggaacttattctctcatgtttttgaggctagaaggctgaaatcaaggtgtcagcgccctgttctctctgaagcctgttgggagaatccttccttgtttcttgtagcttctgctggttgccagcaatccttgacgttctgtggcttgcaaacgtgtaatttcaacctctgccttcacctttacatggactgctgtgtgtcagtaacttcacatcatcttccctctgggtgtctctgtgtccaaatttccttgtaaggacactactcattggattagggcccaccctaatgtcatcttaacttgattacatcagcaaagatgccctacctcctctccatttatttatttatttatttagagacgagagtctcactctgtcgctcaggctggagtgcagtggtgtgatctgggatcactgcaacctctgcctcccgggttcaagcaattctcctgcctcagcctcctaagtagctgggactacaggcatgtgccaccatgcccagctaatttttctgtttagtagatggggtttcaccatgctggccaggctggtcttgaactcctgacctcaggtgatatacccgcctccgcctcccaaagtgctgggattacaggcgtgaccactgcacctggcttcctctccattgaggaatatgatcatgttcacaggtactgggggtacctgaacttgaacacatatttttggggaacattattcaacccacaacacacactttctgatttctcttgtgtaatgattagatcagtagttcccatcttggggctcttgagatttttaggtgttcccaaagttatataccttgaaagtccctgccatgacacttattagaccagattttttgatatgttgttaagtcatcctgaccctgtttatgtacaaactcaatctttgtgtggttgatggtctacatgagatatgtcaagtgtttgtcaatggatttggtccatagtaaatgttcactaagaggaagaggcagtatttaggaacatatattctatgttaaacagcctaggttgaaatgttgacttctcttatttgctatgcgatcccgtgcaagttcctgaattttgctgtgccttggttttgttatataactcctggaagtgtgacgatggccacatgagttcatacatgaaaacctcttagaaaatgcttgggacacattaaaaactcagtaactgttagctactattaccttcaaaatataaccaagtgacaaaaggggagtacaactaatcctcagaaaatcagattaatattctggctttgcgacctgtacaaagtacttaatttcccagtttagtgcctttgtctgtgaaatgatacgtaacttttatggctattatgatgataaagtaagaaatgcatgccaagtgcctaacataaaatcaatgctaagaaatggtagctattattagtaataatgataaagaattttgcaaaaatttccctttaaatcctaggcgttggtcatattgaattacttgtagtttctcaaacatgttctcttgttttcatgtgtacctgctgtcttgctttgctactccactgtattcttcacttgattgcctcctactagttcttcaagatgcaggtgtttccttccctggaaaacatttcctaaagtcaggggacgtgttttctgttttcctctattattgtacttcttatactctctaattttctattgacctattttcttccaatataagacactttcttcttgtgtgattttcagataagctactaaagtcttggtttcctcatctgtgaaacagggatgtaaaaattaaatgagatgcacttggcacttaggccaatgtctagcaccttccccaatcccaagaacataataggcagtcaacaggtgtttacttatgaaatgaaaataatgatttacaaattttattcaatctaaaaaaaaaatcagaatgtgtagaccatacataggagagagggcatccccccaaaatctgatgttaagtgaataaaatcaatgtcatgaagcagaatggtggttgccagaggctggggaaaagagggaatagacagttattgtttaatgaatacagtttcaattgtataagatgaaaataattctgaagatggatggtggtgatggttgtacaacttatgaacatatgtaatatactgaactgtacacttaaaatagttatgacaaattttattgtatatattgcaccacattgaaaaaaaatcaacatcatgaatgagattaaaacaaaggtcattttaagagaatatttctcaggccaggaaagacctggttatagcctaattagtagtgatattaacagtaggggactagtcagcatggaaacacacacaaaaaacagagtcacgttgccaggggagatgatcaatctggggactagataattccagtcactttaaaataattttgttacaaagcaggggtggtttatcaacttcaccacggcctaaaagaaatatgctcatgcataaacctctgaacaggtgatttggtgtgcagagtgctttggctttgctgtttagagagaagaacactggaaaacaggtgggtgtaggtgttgtcaatgaaaagaaagattatcctttgtaaattaatgagatggtatcctgatttatgcatatgtcccttctgttctgagtctgtttattaggagtaagtttccctttctctgatcaactcaagattgactttataggtatgaaaaatccaaagcaaaaccctcagcaatcatgacctaccaataaatgaaatgacagtttaggaatccttctgatcccccaaaaccacaacagggcaaagttcattggtaaacagcaaaaaaaattacatgaacactataaacattttttagatattttgtctttttttcaaaggaataatagtaacaaaaaaacaagagagctcataaaaagtattctgagtataaggaacataatcttaatattccatactactcatttttcaaagaatatatccaagactttgaaagtggaatcagaaatggaaaaaggaccaaaaagaaaaaaaaagatagtgaagagaatccagaaataatttggtggcaggtttttattttattcatttatttttgagacagagtcttgctgtgttgcccaggctggtgtgcagtggcaagatctcagctcactgcaacctctgcctcccaggctcaagcgattctcgtgcctcagcctcctgagtagctgagattataggtgtgcgccaccatgcctggctgattttatatttttagtagagacagggttttgccatattggccaggctggtcttgaactcctagactcaagtgatttgcccatcttggcctcccaaagtgctgggaattataggtgttagccaccgcgcccagccctgaagcaggcttttagataagattgcatgtccatgaaaattttgagggaagaaaaaaacttccaccctgttgcaaagattaaggcagtgaaaggaatctgaaaaacactggatctattatgaccaagcttgtctgctcttaatgcattccaaactcctagttccactttgcatttcaatgtagaaatataacagtgttggtaacaaagtaacatctgacattccatgataattcttggggaaaggaagtctcttttgtgaaatatagatggagtcaaatgccttaggagaagttttggtcaaaacgtggtcctctacatgagctctagaagaaatcattcggctccttctactgctgtcgtggaaacaggtttcacatagtatggcccttcactcaggtaagttctgagcctcaaataatttgggttcccaaagatttctgcaattgtcttggaattggcaagtgctttcactagttcatatttggcatcctttgaagctttgtcatgctccacagaccggtccaccacatattctacaaaacctggactgttaaacataagtttctgagcccagggttggtttgcaatggcctgaaatggaaggcagaaagaatacaattcccctgagtggaagttgtttgttaatgggatggcacaatatttacaaagaaatctggcaacatgaactttaaaaatgttaccttttgtctaagtaaattccttcctgagaatctaacttaataaaataatcttaaatatgaaaaatctttgtatacaaaaatgttcataatagtgtgaaagttacaatataaatatctaataatgggagaatggttaagtaaattatggtatatagcaataaaaataaacattaacaataatgtttacaaaaaataggaaatgatacaggtaaacctgttatataaaaaaagcagattcaaattataaacaatgcatgattacaacagtggaaaaataaaaactaaagtagaaaagactaacctcaagatactcatatagtgcacaaacattttcaagaatgttcattgtggtatcatttgtaagatactatctaaatcttcatttataggagaatgatatattgtggctattcaatgaaataccaactttctaactgcctcttttaacatagacaaattttaaaaaaacgtaacattgaagagaaaaaaaaaaaaagcaaaaactgcaattacttttgcaccaacctaatggaatgatacaaacagcatgataccacttacaaagtttatgaatatctaaaatactgtgttttatttaaggatacacacaatatgtagtagaaatatgaaatcatttatgggccctgactttgtgatagtgattttatctaagaacagaggaaggggaataggactgggcagaggtagcaagatacaactatatttgaaatatttcaccaaaaataaacacacactaatacaaaaactaaaaggaaatacaccaaaaggtagaactttctgtgattttaaaaaattctacttctaagtcttttccaaattttaagattaagtttttcaaaacctattacgttttaatgaaaaagaagtaacaagtttatggcctagttttttcctctcaaaatgtgttccacagacaagtagcatcagcaacacctgcgagcttgttagactttcaggatcccaggctctgccccacaactactgaattagaatctacattttaataagattcctaagattaatgtttgagaaactttggcctgcttcacaaccaagcatgaaagtaggcagaaataaaaatagttatcccaaccagtaaatagaaaattatttctacaatggaaccagctaagcacaggataaggtagaagagcaaaaccaaaataaactaataatgaaaatactaagcaggatccaaaatggccatctcatacaatgaccatttacaagggtgaagcagtcttaaagaaatgtttctggctaggcgcggtggctcacgcctgtaatcccagcactctgggaggccgaggcgggcggatcacaaggtcaggagatcgagaccatcctggctaacacagtgaaaccccgtctctactagaaatacaaaaagaaattagtcgggcatggtggtgggcgcccgtaggctagctgctcgggaggctgaggcaggagaatggcgtgaacccgggaggtggtgcttgcagtgagccaagatcacgccactgcattccagcctgggcgacagagcgagactctgtctcaaaaaaaaaaatgtttctgaagattataggaatacctgtatccttcaagacccagatcctgtatcgcatcctcaggaagccttccctcttttgtccctgccattttccttattccctcccagtctaggccatgtatgctgtctgagatcccattattgatatgattactaaagcgattactatcttgctatgctggggctacaaagataaatcagatatgcttcctgctctcagccaactctacttaataggtaagacaagtcgataaataaacatttgcaaaataatataacaaatagaacacaaaggtataatccttaccacagctgtaattatataagtaactgtacaattatatttactgcctggctccttcaatagacaggaaactacatgaaaggaaggtctttatatattttcttcactgttgtatgcccttcactgagcaaaaacggaaactcaacaaatatttgctgaataaataaatgcaacatatgagaaccaacattgtttaactcaaccttgtcaatctgggcaaagtgtgctgaagacaaggagttagtccttgacgagtgagtaagaggttaagaagcaaagttaaggaagagtgttagatacggagaccccagcaaaggtccagagacacaaaacaaacagtttggtaccactggagcattaggtgccagaagccttattttctgcacgggaaataaggattaggaagaccagggctaggttaatagaggatggcagataaaaagtctggaattaactgtgtgatcccatagcatcctgttcaaacctcaaacagcacctaatatcttttactgaaacaatctgtttacacatctgtctccttacttagtctctaaggtagcagaaggtagaaactatactatgcacttgtgcatccccagagatggcacaggctctggctcactgttaagtactcaagtgttgagctggcagggtcccagaaggacctatggaagtgaatacctaccgtaaacacttttaaggcagcacagtgtagttcagggaagggctgactactaatgccacggaagagctccagtggatcccgagataaagaagaaaaccaggattctgtcatcctcagaaggtcatcagtctgctgctcaggctacaggaaagaaaaggaaaatctcatcaaaagttaactgatctggagaaaagcacttatttagaagtcagacacctgagtgctgatggcactctgtcattaatttgttgtgtgaaactggctaagtctggaggactctttctcaaatccagcccagacctttcccagttttctttgaatgtggttgattaagcagtctctagagtctcttcagttctaacactctatgattccattttaaattaaaaatgtcactagtcatataatgagggttatcttcttgtatttacttcatcacatttatcatgttgattcatacagatttattctcccaaacatatcccactgtccttcattatttccctacctacttactggtaagtacagaagagatgaaattgcatccaaacatctaatttttagctccactggggcattctttgattgatgtcctattctcataagcaagcgttcaaagcgagttcctttgaaggataacagtgagattcttctttattatggtaaaatatacacaacataaaatttaccattttaaccatttttagtgtatagttcagtgctattaagtacattcacactgttgggcaaccatcataaccatccatctctagaactttttcatcaacccaaactgaaactctgtatccatcaaacaataattccctttcttctctaccctcatcccctgccaaccactattctacctcctgtgaactggactcttttaggcatctcatctaagtggaatcatacaatatctgtccttatgtgtttggcttacttcacttagcataatgttatcagtggcgcaggcttcctccatgctgtagcatgtgccagaatctcattctttttaaaggctgagtaatattcaattgtatgtatataccacattttgtttattgattcatctatcaatgaacattgggttgcttgcacctttttttggttattgtgaataacgctgctatgaacatgactgtacaaacatttgtttgagtctctgctttcaattttttttggtatatacctgaaagtggagctgctggatgaaggaaatataaaatgtacaagggttacaatttctccacatcctaacacttattattttatgggtttttttttaaagtaatagccatcctaatggatatgaagtgaaaaatgagatttttttaaagtatgctctcatacactatgacctctaccaacctaaaccaatacaaaaataagcatgtagtcagagaaccagtgacaggcctagaacacataattacacgcaacacagcatatataaggcaaagttataaaactggaatcaaaggacctggacttgagtagcagctgccataatttgtatgaccttagaaattttcttaactcctctaagtttcatctaccttatctggaaaatgaaaatgacaatgtatgttctttgcaggactgtaaaacgattgtcataggtaaaagcacttagaaaacgacatataacaaaaatattagctgtgatacacaacagcgtattaattttctttttttctttttctattttctaatttttatttttttgagatggagtcttgctgtgtcacccaggctggagtgcaatggcgcaatctcgactcacggcccaggttcaagcgattctcctgcctcaacctcccgagtagctgggattacaggcgcctgccatcacacctagctaatttttgtatttttagtagagaccatgttggccaggctggtctcgaactcttgacctcaggtaatctacccaccttggcctcccaaagtgttgggattacaggcatgagccacctcgcctggcctctttttaaattttttttttgagatggggtctcactctgtcacctaggctgcagtgcaactgagtgatcaaggctcactacagccttcacctcctgggctcaaatgattctcccacctcagcctcccgagtggctgggactataggcatgcaccaccacagctggctaattttttttgttgttgttgttgacgaagctggtcttgaattcctgggctcaaacgatcctcccgccttggcctcctgaagtgctgggattacaggtgagataattttcaacatatgtgtctcaagaattttaataattgggctgcatattattttgtgtgtaaaatttgttgtgctgttgatcctcatggatgttccataaaagtatctttctttctttctttttttttttttttacagagtctcgcactgtcgcccaggctggagtgcagtggtgtgatctcggctcactgcaacctttacctcctgtgttcatgccattctcctgcctcagcctcccgagtagctgggactgcaggcatgcaccaccacgcttggctgatttttgtacttttagtagagacagggtttcaccatgttggccaggctggtctcgagctcctgacctcaagtgatccacctgctttggcctcccaaaatgctgggattacaggcatgagccaccatacctggcctctttttttttttttttttttgagatagaatttcactctgtcacccaggctggagtgtagtggcatgatctcagctcactgcaacctccacctgccaggttcaagagattctccttcctcagcttctcaagtagctgggactacagttgtgcagtaccatgcctggttaatttttgtattcttgagtagagataggattttgccatgttgcccagcctggtcttgaactcctgagctcaggcaacccacccaccttagcctcccaaagtgctggattacaggcatgaaccattgtatctcttaacatgccaaaagtatctcttaacatgaaatcttataacaaacttttattttcctttctcaaaatttcataaatattcacaacaaccctgagaagcagttgttatgccatttttataaatgaagaaaatgaggcctagaaaagtgaagtgagtaaatgaagttcaaaaagcaaagtcagggctggatacaatggtgtggacctgtagacccagccaatcaagaggatgaggcaggaggattgcttgagcccgggagttcggggccagcctgggtaacagagagacactctcaatctcttaaaaaaaaaaaaaaaaaaaaaaagaatagaaaacccaaggacatgaatccagacctttctgactctagcccgtggtctttgtaccatgaaatctagtcaaagaagacatcatagaggggaaacaggaaacaatgtttggttgaaatcgattggtagaaacctaaaccaatgaaaacctaaaccagtgaaaagtcaaaaaaaaaaaaaaaaaggttttccgtaataattattagattttcagacatgagtacaaggtcatggttaacaagactgccacccataaaatagtttctacaatgtagttaacccaccagcaaatgaacttacatattgaacccctgtcaaagattaagatatccctgaacagggccaagtcataccaacctgttttctgtaaaacctgttttccttcaacattggatcccaagattccaactgtgtctacagctacaccaatcatagtggggtcctgactttctatcatttcaaagactttttccacaaagataggataacgctcacagatctgttgaggactatccatgacagccaggtttccaaaaaacttcacgaatcctaaagagatttacaaaaatatattttaataggggaacaagacagcatgaattgcgggctctatgacttcacaggaacagaaatgaactgcaggccagaaaagcatagaaaggttagagtagtgtgttgcctggagatcagagagaccattaggagattctgaaggacctgtgatgtgtgatcctgagagagggcgtcaatggagctgggaccagctattgaagtactggcatatgcaagagggagaacaaagaaaaaggaccagtggatacaaattacaggaaggcaagtttagactcattaccaggaagaaatttttaaatggatatgttcattaataaaataagctaggctacctaaggcaggcatacatctccaatttctggaagtgttcaagaaagactaatcaaccaaaacccagaatagaatggcaagagtagatcctacaacagataaagactcccactcagagatgtgattaatctgtgaaacatactgtaaatgtcattactagtatttttatttatgtttttgttgatattcaaaaagaaaaatatcctaatgttctaaatagcactgatgtttccagaaaaccaaagtcaacagtacgtagctccaagagcaacagattccacctcaataagaggctataggtatctttttaaaaaaattaacttttaactgacaaaaaatcatatatctttattgtgaacaatgtattctgaaatatgtatatttaaaaattattttttctgctttcgtgaaaaatgtcattaaatttaaaaattttggagggaatgcactgaatctatatagtgctttgggcagcatgaacattttaataatattaatccttccaatccatgaacataggatacctttccatttatttgtgtcttcttcaatttccttcatcagtttttatagttttcagtgtacagatctttcacctccttaaatttattcataaatatttaattttttttgaatgctattgtaaatgggaatgtatctttgattactttttcagagttcactgttagtgtatagaaatgctacggatttttatgcactgattttgtatcctgcagctttattgaatttatttattcattctaacagttttttggtggaaactttattctatatattaataaaacattacatcacttgcaaacagggaaattttcacttctttctttccgatttggatgccttttatttatttatcttgcctaattgctctggctataacttcttgtactttgctgaatagaagtggtaattgtgggcatccttgtcctgatctttttttttttttttttttgagatggagtctcactctgttgtccaggctggagtgcagtggcgcgatcctggctcactgcaatctccacctcccaggttcaaaggattctcctgcctcagcctcctgagtagctgggactaccggcacccaccaccatgcccggctaattttttgtatttttagttgagatggggtttcactgtgttagccaggatggtctcgatcacctgacctcatgatctgcctgccttggcctcccagagtgttgggattacaggcatgagccactgcgcccggccttgttcctgatcttagaggaacgctttcaacttttcaccgctgagtatgttagctgtgggtttgtcatacatggcctttattgtgttgagatagattccttctatactttatttgttaagagtttttatcataaaagaaaggtgaaatttgtgaaatgcttttcccgcattacttggttgctgtctttattctgttaacatagtatatcttatttattgatttgtatatgctgaaccctccctgcatccataggataaatcccacttcatcagggtggatgacccttttaatgtgctgttgaatttgaacttggttgctctagatatcttctaaacgaaatcagctcattaaggaaatcagctctaaaggaaaacaatccctgtccactccctaccccaaccccctgatgtcagagataactcagaaataaaacacgcaccatcatttccataggcatcagtgttccttacctggcagatagaagctagagaaagggtctgaatctgccccaacaattatattagaaatttggtcaattactccttcttgagcaagatattgtcgcccatgatgagtatatgccagtgatgtcaccatttctatacaggtggctctaaaatgtcagaaggacaaaaacaaggagattttgcacaggatttgcatagtttataaattgctctcatacaggttatcttatttaattcttcttatcacattcgaaaggtcaataatcttggctcctcttttcacatgaagccctaaggcctagaaatttgcagtgacttctctgtaatcatattgttattataggcagagtttagatttaaatcttgaccttctgatttgaagtccactattgtttccactataacctagctgcttcctaaaatattttctaaatttgtgttttattttgaaatatcatacacaaaagtaatgagaatacaataagcccccatatacacataacctgattttatggttatgaagattttgctttacttatttcatctcttttccctactttttgctgaactattttaaagcaaatcctagtcaccctgccatttacccctgcatactttagtatgcatctctacaaaacacatatgtttccttacacaattataatgccactgccacatattaagaaattaacaataattctttggtatcatctcatatccaaccatgatcaaagaaaataactaaaaaatttatttagttggtggttgatcctaaactgttttgactgaccatttacaggtttttttctatgtcacaaaatttgatacaatgctaaaaaataattaacaaaattaattgtctcattaggttgagacactcaaatgcactgaagcaatgtaactagtgactgatttactcatatgggtttaataaattcagccatgtttaaagaacacaggacaatcagaaaatcatttaagataagaaaaatcaaaacctatatacacaaagataactataatgctatcataacagcaaaatacttgaagcaaatcaactgttcaacagtgaggaggtattagtaaactgtggaatatcaacaaaagaacatttggcagatattaaaggggatttagggaatagcgggtggaagagactggaattaacatttctttgagaacctatgtcagccattgtactgctttctatggtcaattagcttaattcttacaatatctttttattttttttgagacggagttttgctcttgttgcccaggctggagtgcaatggcacgatcttggctccctgcaatcttcacctcccgggtttaagcaattctcttgtctcagccttcccagtagctaggattacaggcacccaccaccacgcccagctaattttttgtatttttttagtagagacagggtttcaccgtattggccaggctggtcctgaattcctgacctcaggtaatccatccgcctcagcctcccaaagtgctgggattacaggctgtgagccactgcacctggcacaatatcttttttagttactgttctgagagatgaggaaactgagatgtagaaagcttataattatctgtccaaggccaaacagctaataaatagtagagaggcatgcaagccaagtcttcctcattttgaaaagctcatattcttttttttttttttttttgagacagagtcttactctgttgcccaggctggagtacagtggtgcaacctccacctcccaggttcaagcaattctccttcctcagcctcctgagtagctgggaatataggcacatgccaccatacccagctaatttttgtatttttagtagggacagggtttcactatgttggccaggctggtcttgaactcctgacctcatgaatcgcccacctcagcctcccaaagtgctgggattacaggcgtgagccaccgcacccggcctagcccatgttttttctatcatgccatagtgttgctatttaacaatgccaaaataaatgaatatgataaaatattagtaattcaaaatggcagttaccacatgattgcaactttttaagagcacacaggcctagggacatggaacagagtcacttgaaagtagctgaattgtcatgtggggctttcccaagttccagtatgttgtcacgatgtaacttgaacaattttctaaagatccctccttcaggacacacatcagtcatgagattgcaacctgggcaaagtctctaatagagaaaatcacagatgtcccaaggttgtttcccagcccttcaaaagaggatatttcactttaagaactcagtcaacacacctgaccaacacatcctcaccagtcagctctctcaggagctgggttaccaatccacttgtggtacagtagtttaaagattctggtgacacggaagaaatctctataattagctgaaataaaaaaaaaaacacagaaaaaagaaaaaggtcaaatcagccctacgcctgatagatctcattttaagttaaatgtaggactaggtactttttataaatgagttttaaaaaatccattatttgtctctttaagtagaaaaacttcagtgaacgcataagaaattactttggcacagattattattattattatttttgagacagagtctcactctgtcacctaggctggagtgcagtggcgtgatctcagctcactgcaacctctgcctcttgagttcaagcgattctcgtgcctcagcctccccagtagctgggattacaggcatgcaccaccacacctggctaattgttttgtatttttagtagcgatggggttttgctatgttggccaggcttgtcttgaactcctgccctcaagtgatctgcccgccctggcctcctgaagtgttgagattacaggcatgagccaccatgccctgccaccttggcacagaaatgttccattatatctaggtgtatcagcactttcccgcccaagcaatcatcaatcagggtacaaaagcctgaatcagccacaacaaacagattataaaaccattcactcattcaggcatcctgtcagtcagtcagtcagtcattcactcactcattcagcaagtatgttctgaggtcttactgagagatataggaagacactgaagggttttaagcagagaaatgacacaatcagatttggacttttaaaagaccattctgactgcatgagaagatagactagggatgataaaaatggatgagtggagaccagtttggatgcaaatatagtagcccaggtgagtgacaccagtaagttagtctagggtggtagaagctgtactaatgaagagaaatgcaggggtttaaataaaatcaacaaaatatgatgaccgaatggatatgtggcaaggaaaacaggcctcagaatgagccaaggtctaatacccaactaagcagactgtgagacacagccagtttgttgtcttattttttattagggggatagggtggataaggaagatcaggaatttgatttcagcatgagtttgagtggcctagaatatacccaaggggccaagagtgagtaagcagttgagcatgaaggttcgagctcagaagaaaggtctcagttggaagtttacatctgagaggcatcatcactgatgggaagtgaaatcataagtgagtaaaactgcctaggaatgagtagagtaccgtgaaagcagggcttggaactctgttttcatcaactccaacaattaaagattcaacggaggataatgagccaggaggctgagaagaaactgagaggtagaaggaaaagcagcatagtatggtatcatgacatgcaaagtaagaaagtgttctgaagatggaattagactatagaggattctatttcaaacatgcaccctattaactgtgtggtcttggatcaattgctccatcaatatgaggttaatgataacaacatacaaagtttactgtaagaattaaagataatatatgtgagtattttagcatagtgcttagtacaaagctggtacaaataagggccatttcttattactactacaaattttttcaagtctggtttcaatatcttctctatcatagtaattatattgcactgtaaatatatatatatatataaaaagggtcttgctctgttggccaggctggagtgcagtagtgcaaccacggctcactgctgcttcaactttctgggctcagttgatcctcccacttcaacctcctgagtagctgggacgacatgcacataccaccatgcacagctaatttttaaaatcgttgtagagatggggtctcactatgttgcccaggctggtctgaaactcctggcctcaaggggtcctcctgcccttgcctcccatagagctgggctgtaagtattttttatgactgtctcacatactaggctgggaatgcatccttatattcccagcacctactgtagggccaaacacagattatatacttaatgagccatcttgcttttcagcataagccaaactgcattctgctttgtaagcatgagaaagtgtgctttttatcttacctcatacaccctgtatcgaacaatgtcatttgttttcattacacttttcaaatcatccagcagattgctttcaaataaagcctccagtccagcttgggttagtgatattcttgacagggatttgatagccttataacgaaagaaaatatctcttacattcccaaaatgcaggttattatctacttcataagagtgatgtaaaaatagtgcatggaatgcaccttgcccatgttttagctattatttataattggaaaagacgcaaggtatcccccatagaattatgatggatactgtagatatgtatatcctagaaaatgaaaggggtttactagtatttacttgacaaccatttattttacacaatccatatgaagttgtaaattccattacgcaaatcatccattctaaaccttcacctctcaattcagaaggcctttctttatcttttgggacaccgatgtctctgcacatttaagtcaatgattctagtagactcaccgcttttgctacagatagattctctccaccaatgcaataaacaatttgttttagtaattcagcattatttagaatctcagtaacagcatcagaattttcaacaattcttccaatctgaaagaaaaacaatcagaaacactcttctaaagtagggcaacatacggtaaacacacgatggtccaatttccttagtgcacagttattttaggagttagtgatcacagctatatatcaattcattaaaaaatcaaaatgacctaaattcattcagtcaaacacacatatggtatagtcacatctttgaaaggaaagaaaaaagaaagtgggtaaagaggtaagatagttcagtgagtgaaaacaatacaaacccagctctatgtttagctacactgaccttgcacaaattttagccccatttcttatccgtaaaatgggaacacaatatttaattccaggatagttacgaagattaaatgagaccgaacaggcaaagcacctgctacagtgtctggcatataaatggccagtgaataaactgatatcttccccctttcccccaacctttttttttttttttttttttgagatggagtctcactctttcgcccaggctggagtgcagtggcgcgatctcagctcactacaacctctgcctcctgggttcaaacgattctcccacctcaggctcctgagtagctgggattacaggcacctgccatcatgcccagctaatttctgtatttgtgtagagacagggtttcaccatgttggccaggctggtcttgaactcctgacctcaggtgatccgcctgccttggcttcccaaagtgctgggattacaggcgtgagccactgtgcccagcgcccttttttgctgaataaacacagaaaaggaaaaacagtagttcagtatctactgagtaactgtttagctcctaacatttcaacaagataatccttagcagcagctcttcactcaaatagcaaggatgctttggttaccaggatgataagagttactgtcttaattgttggtttagtgacctttacaatagcatttggttcatccagtgtaaagaatctaaaatggcagagagctatttgaacacataggaatctttttctttacactaggagctccttgaaggaaagtaatcagttttgtttatcttggtaactctaacagcatatggcaccatgcctggcatgtaaaaggaactcagtcagtatctgattaatgaatgatttagatggtacttaatggaacttctttctttagcttgtatctcccaggttatagttagctatgcacattggaatagaccacacatttcctagggggaaagagggagcagaggagagggggagaaggaagagggaaggagagagagaaatactgtgctttcttcatctttctgtcccagtgcagaacctggcccagagcaggtggtcaatgtcggttcctagtagaatttcatacctgggaaagagtgaggatttttacagaatcatcagggtgaattagtcccctctgcaggtcaaccctgaggttccgggccacgtgaaccggttccatagcttggagcaatctctccagaatggatacacacaaagtagtcttttccctgaaggagacatcataaatcttattagttcatatcctgcccaggtaggaagtaacaacctaataatagctgaagcttgcgtcagcgtctcctccacacagacttctttttgaaacagcagctttcactcacctactaaacatttgctaagtacctattatgcgcattgcctgtgctggggcaacagagaagaataagatatgcactctagtcttcttttttttttttttttttttttttgaggtggagttttgctctgtcgcccaggctggagtgcaatggcctgatcttggctcactgcaacctccacctcccaggttcaagcaattctcctgcctcagcctcccgagtagctgggattacaggggcctgccaccatgctgggataatttttgtatttttagagacgaggtttcaccatgttggccaggctggtctcgaactcctgacctcaggtgatccacctgcctcggcctcccaaaatgctgggattacaggcttgggccaccgcacctggccttttttttttttttttttttttgagacagagtctcgctctgttgcccaggctggagtacagtggcacgatctctgctcactgcaacctccgcctcctgggttcaaacaattcccctgcctcagcctcccgagtagctgggactacaggtgcatgccaccacacccggctaactttttgtatttttagcagagacgggggtttcactgtgttagccatgatgatctcgatctcctgaccttgtgattctcccacctcagcctcccaaagtgctgggattacaggtgtgagacaccgtgcctggcccgatatattctctagtcttaaggagctcaatacaatgaaagatacagaaaaaaaaggcaactgtaatccagataaataaacgctatgggctaagactagaaactataggagcttaaaaaagaacagagggtacagggaaggcttcccagaagggtaacatctaaactaaattttaagaaaaagtaggagttatccagaagaaaagtgttctaggtagagggagtagcagcacatgaaaaggcagagaggaataagacatagtattatactttcaaggaacaagtagtttggtatgattggggtcagaatgggagagaggtggtgagaaggtaaaagggtgaggtgaaggacaagaactgaaactgaaaagatgcacagaagccagattctaacaggtattttatgtcatgcttggaatttagacttcttccagaaaatcaatggcaggccataagtggtcttaaagaagtaaaatgacgagatctgacttatagaattcactctgcaccagtgttaggggaagaattttcaattacaaggcagtaaatggtgagaggtgatgaaggagtaaaccaggggagcagcagtgaggatagagagaagagggaagaactatgtaagagaaactgatgactaccagtggtagatacagaagatgttttcagaacaattttcttgtctcttaatagacactacaaataaatgggctaatatattgttagtagtagtacacaattcaactgatacaaccttttgggtaggtaactacatgatacaaatgaaaagccttaaaaatgaacatactcttttaattcaggaatttcactttgcataattgaacctaaggtagtattaagaatgtttttataccaaagataattgaaaacatgctattttcacaaaacttgtacacaaatgttcacagcagtggaaacaatccaaatgtccaccaagtgatgaaaggataaacatgtgttatgtgcatataatgaatattattcagccataaaaagcaatgaagtaatgatacatatcacaatatgaataaacctttaaaatattatgctaagtgaaataagccagacacaaaaggcttccttttgagaatgattctgtttatatgaaatgtccagaatagacgaatccatatagaaagtagattccgctaggctcggtgactcacgcctgtaatcccagcactttgggaggccatagcaggtgggtcacctgaggtcaggagttcaagaccagactggccaacatggtgaaaccccatctcaactaaaaatacaaaaaaaattagctgggtgtggtagtgggcgcctgtaatcccacctacttcaggaggctgaggcaggagaatcgcttgaacccaggaggcggcagttgcagtgagtcgagatagcgccatcgcactccagcctaggcgacaagaacgaaactctgtctcaaaaaaaaaaaataaaataaaataaagtagattcctggttgccagaggctggaggaacggggaagaggaggaatgaggatacttacaagtatggttttcttttccttttaaaaaaaaaatgtgattacaggtaaaatttaccattttaaccactcttaaacgcacagttctgtgggaataagtacattcactttgttgtccagccatcaccatcgtccatctccagaacattttcctcttcccaaccagaaactctgcatccattgaacactccctattctcccctccccaagcacctggcaaccaccattccactttctgtctctctagatttgactactctaggtatgtaagtaaaagcatacaacatttatccttttgtgtctggtttatttcatttagcacaacgtcttcaaagttcatctgtcagaatttcctttctttttgaggcaagatgtacaatatcccatcatatgtatataccccattttgtttatccattcatcccttcatagacactttggttgcacatgtgggttgcattgcttctgtgccttttaaaattttagccaatctaatagtgtgcagtagaatctcactgtaattttaatttgtatttccctatttaatgttgaatatctttctacgtgcatatttatcatctgtactttttttttttttttttgagatggagtctcgctctgttgcccaggctggagtgcgatggcgtgatcttggctcactgcaacctccacctcctgggttcaagtgattctcctgcctcagcctcccgagtagctgggatcacaggtgtctgccaccaagcccagctaatttttgtatttttagtagagatggggtttcaccaggttggccaggctggcctcgaattcctgacctcaggtgatccacctgccttggcctcccaaagtgctgggattacaggtgtgagccaccatgcctggccccatctgtacttcttgttcaaatctttggcccatgttttaattgggttatttattttcttgctatttagttttgaaagctccttacatattctgaaaagaagtcttttatcagatatattcttcacaaagatttttctccatttgtgacttttcttttcattctcttaactgtatgtaaccttcgaagaaccgatttttttttttttttttgagactgagtctcactctgttgcccaggctagagtgcagtggtgcgatcttggctcactgcaacctctgcctcccaggttcaagcgattctcctgcctcagcctcccgagtagctgggactacaggtgcctgccactatgcctggctaatttttggtatttttagtagagatggggtttcactgtgttagccaggatggtctctatctcctgacctcgtgatctgcccaccttggcctcccaaaatgctgggattacaggcgttagccaccgcgcccagccaatttttgtatttttagtagagacagggtttcaccatgttggtcaggctggtctgaaactcctgacctcatgatccgcccacctcagccttccaaagtgctgggattacaggcgttagccaccacctagcctgaagaaccgaatgtttaattttgattaattctactttgtatcactttgttcttttttttagacaagctctctctgtcacccaggctggtgtagtggagcaatcacaggtcactgtagcctccacctcagcctcctgaatagctgggaccacaggcatgagccaccacacccagctcaatttattcttgtatagatcatgcttttggtgtcatattaaagaagtctgtttaactcaaagtcatacatttttttttcctgttttcttctagaagttttgtagttttaggttttatatttaggtctatgatctactctcatacactgctggtagaaatgtaaaatactataaccactttggaaaacagtttgccagttgcttaaaaagttaaatatacacctaccataccatctagccatttcattcctagctatttactcaaagagaaaagaaagaatatttttatgtaaagacttgtacatgaatgctcacggcactgtcatttgtaatatctccaaacagaaaacaattcaaatctcaaatgttcaccaacaggggaatggataaaaaactgtagtacattcatacaatggacttacactcaacaataaaaaggaatgaactatttattcatgccacatagataaatctcaaaataactatgctatgtgaaggaaaccaaacaaaagaatacataatgtatgactccatttgtatgatcccttccccccatgtctggccaaaataaagggcaagttcatctacagtgagagaaagcagatcagtggttgactggttgaaacagggagagattagcaaggggtatgagggagcctctgggagtgaaagatacattcactatcttaattgtggcgatggtttcatgggtatatacatatgtcaaaacttgccaacttgtacgttttattaagtgcagttcattgtatataaattatacctttgaaagctgtttaaaaaaaagtagtggtacgttaaactgcacagtgcacaaatttcagatcctatgtgacccttctttgccaacgagccaaagagttaatgcttaaaattagtcttgtttgattttcatgttctaaagcagtaatcttaggacttaaactctctcaaaaaaaactgtcaagattctaacttacatctgcaagatcagattgtgaaccaacacacaacaacttatgtggtttagccaggataacagcaaagtatctgaagactgccagatactatccagagaattattcccacaaggtgcagttggtatctactatgtatccagttctgaattattctgtctttaaattccattaaaattgttccctaaagcactgctccttcattcagcaaactatcttccccatggacctgaatcctcaaattctgcctcacttcagttcctactgcatctctgctgtcaacttgcggtatgacctctggaagtctcttcatctctaataggagaggttggacaaggtggccactctaaactctgtgagtctcaaatttaattgggcgtatactgcattatgtgctgggccctaagagggatgcagacatgaacaaaatgcggtcactgccttcaaagaatttacaaactggaaatagacacacagagaactataacataggtaatagtgtcaattatcattaacagaaataacaataatgtcctttagcagatctaaggagcagtcatttgcaactggaataattgagaaaaatattttggaggagatggctctttagtgggcctaaaaggatggacagaatatggacagacagcaaagtatttcagttagaaaggctggtatgagtaaagttaggaaagtgcaagtcaggcttaaggaaaaataagggtgccacatggtagctggagcagatgaaaagaagtggagtggaggaaaaaagtgaggttggaaaagtaggatggaaatatactgtaaagggcccaaatggcattctaaaaactcactacaggcaatgggaaaccacggaaaagattagcaccagctgactcgagatgtatgctcactggggttacaaggtgggaaggaatttgctagaaaaggaatttgctagaaaaggaatttcagaggtaaggagaagtcagactaacactacagacctagcaatagggaaaaaatgagggcttgaattaaagaggagacaaataagagacatttcataggcagacccaaataatgttaactgatagacatcatgaatggagaacacttacagaaaaggaaggaatcttagaaggtcagagccaagaaagcgctctgaaatcatccactgttgattcagtggttcataatcttttcaagtagtaaggtcacttgaaagtctttgatcacaaacatttcaaaactcttttaaatgatcaaattatcaaatacaaagtggtttttttttcctttttttccccagaatccaggtaagaattataaaatgtttttttaatctttttttttttttttttttttttagacagagtcttggctgggcgcagtggctcatgcctgtaatcccagcactttgggaggccgaggcaggcaaggcagatcacttgaggtcaggagttcgacaccagcctggccaacatggtgaaactgcatctctattaaaaacacaaaaaattagctgggcgttgtggtggtggcacgtgcctatagtcccagctactcaggaggctgaggcaggagaattgcttcaacctgggaggcgaggttacagtgagcttacatcctgccactgcactccagcctgggcaacagaacgagaacccgtctcaaaaaaaaaaaaaaaaaaaaaagggcctcactctgtcacccaggctggagtgcagtggtgcaatcttggctcactgcaacctctgcctcctgggctcaagggatcctccccctcagccctctaagtagctgggactataggcacgcacgcccagttaattttttgttttgttttgtagagacagggtttcaccatgttgctcaggctggtctcaaactccaaagctcaagcgatccacccgcctcagcctcccaaagtgttaggattacacgtgtgagccactgctcccggtctacaaagtgtttttattattattattatattattattattatcttgagatggagtctcactgtgttgccaggctggagtgcagtggtgcaatcttggctcactgcaacctccacctctcaggttcaagtgattgtcctgcctcagcctcccaactagctgggactacaggtgtgcgctaccaagcccagctaatttttgcttttttttttttttttttgagacggaatctcactctgttgcccaggctgaagtgcagtggagcgatctcgtctcaccgcaacctctgcctcccaggttcaagagattctcctgcctcagcctccagagtagctgggactacaggcacgtgccaccatgcccggctaatttttgtatttttagtagagacagggtttcactatgttggccgggttggtctcgaactcttgaccttgtgatccacccgcctcggcctcccaaagtgctgggattacaggcgtgagccaccgtgcctggcctaacttttgtatttttagtagagacggagtttcaccatgttggccaggatggtctcgatctcttgacctggtgatctgcccgcctcagcctcccaaagtgttgggaatacaggcgtgagccactgcaccgggcctacaaagtgtttttaatcaaacactacggatgtgtaaaaaatcaaaaataaaagttgtcctactattttcagacccacttccctattaatagtttctggtgtacctttgcagatatttgcaatgttatacaagttttacatgcctgtgggggttgggaagattgtaatcctttttaaaaattacaggttaaaattatagattgatataccctgcgattttctttttcattcaacaacacagagattggccgggcgcagtggctcacgcctgtaatcccagcactttgggaggccgaggcgggcggatcacgaggtccgtagatcgagaccatcctggctaacatggtgaaaccccgtctctactaaaaatacaaaaaattagccgggcgtggtggcgggcgcctgtagtcccaggtactcggcaggctgaggcaggagaatggcgtgaatcagggaggcggaggttgcagtgagccgagatcgcgccactgcactccaacctgggagacagagcgagactcgtctgaaaacaaacaaacaaacaaaacaaaacaaaacaaaacacagagatctttccatgtccacatacatatatatacatctacctcaataacttaaataactgcacagtgttacagagtaatagcgcataatttggaatcctctgttaacggatatttagattgtttctagtgttctggtgccacacacgatatgttatattcttgcatataatgttgtagggtcctccagtcgccccctttctttctctgtcctgatggaaaatcagagtgccttgattgctctctgacctagccagcggcaggtttccctagcaggcttgaccataaaccaggggccttgaacattcacaggcctgataaaggtacctaggttgttgcccaaaacactggaagaaactggcctcaaccctgagccaaattcctttaaactctcatctgaactccataccctgaccccctcactgcggacatacccaggaacacctttctcccggtgtccgtcttgacaatttctgcagccctctgcaggtttccccctaaacgcttttggactgatcgccttggcattcagtgcttctttttctgtcatcccaaccagccacatctcgggaaggtttgaagcactccctcgtgggaactctcttgccgctgcttttggggcgattccagcctcgggttcgaaagaacaaagtaactgcacattttgtgcgcgtatacttgcattaaatttttttaacaagaatgactggatgaaaaagcatgtgaatttaaaatgctgatggttcttgccacattgccaggataggatccttttagaaggggaaacaaatcaagaacctgtacaaagagatgtggaatgctccttgtaagtggacagctttgctttcctcctttaatttctatttgatgaagaaggcagtgcctcactgctcagaggcagcgaggccaggcgacgggagaaaacaccctggggcactctcagaggctgaacctgaaccccatctcctgcctctgaacccaggatccttccttctctgcaaatttcggctactttccacctcccctgtgactgggaaaagcgctgttcttgccctcaaccactctcatgtccatatttaggggtgcccctctcctcggctcaagcccccggggtcctctcacctatggttctcgttaagcagggagaagagcgggccgaggcgcagctccgccgcttgctggcgaagctcgttgagcggcactgcctgcagcacggagtgaagcgcgcgtagctcctccagcggcgcttccagcctcgctacctctctcagcagcgccaaagcctgggctgccatcttgccccccgacgcaggggctggcccagcggcccagttcccggggcgctttcctgaacctcgcgagatctgatcacagcctccttgtccctgagatggctatggggctgccaagcctcgcgagaagcctccgttagggccgtgtcaactgtagccagtggttgcggctccctcagtctggcgtcatctaggtcgctgctcagggaaatgcggaggccagtaggcttacgtgtttaccgcgtagggcaaagccttgccaaattcccggccagcggagcggcgagggtggggactcacgggaagttaaacagcctcgtcggcgtcctcgaggctccaaaaccaggctctaggcggggacgactgcagccgttatggaggccaccgcggctacggccgcggctgaggcctccccaggtggagcggtggcctggaggggaatcttgatcctgggccagccacctgtcaagaggaggcggagcgtcatgcctctggaagactggatgaatattctccaggagcctgacgaaggcgtgagtaatagggacgtgcgccgccttgttggtgttgatcagtccaccaaggagaagcagctggtcgcagtggccgtacctgtaatcccagcgctttgggaggccgcggcgggaggatcgcttgagcccgggagttcgagaccagcctgggcaacatagtgagaaacccgtctctaccaaaaagaaaaaaaaaaaaaaaggaaaaaaattagtgcggtgtggtggcacgcacctgtagtcccagctactcgggaggctgaagcgggagggtcccctaagtctaggaggtcgaggcttcagtgagcggtgattgtgccactgcactccagcctgggcgacagagcaagaccctgctttcccctcttgtcctccactaccctcaggaaaccaagaaagaccagcgtggagagttggtcgcccatctgctctaagctgctgtgtattcccctgtaatgtaaacatcgtgaaggtggagacccagttaaccttttaggtggaaggccagatgacagagggcggcatctgacccggaaggccctctgcaaccaggccaaatacatctacagggaaccaatgggaaacatctggggaggacaacccaaataagtatcatgcgagcaagggatggtttgagaactttaaaaatcgctgctgttttgcaacatacgaagttgatggggaggaaggacccttaaatcctgagtgggtatcgagtattccaagcaactggagagaggctttgtgcctcaacaggtcttcaacgccaaggagatgacccatcttttgcagtgcatgccttcctacttttggggcaaaagacaaaaatctggaaagcttagaggaagctaaggacaggatttccctcatttttttgtggcagtgcctcaggtgacaaaatgataaaaccactgctgctttacaaagactctaacaccccacttgtcttttagagataaacgccttcctgttttcttgtaatcacacccagaatcaccactgccactttttggattagttttacaatttttttatccatcaaatccgaagtcatttaacaaaaaaaatctggaaatcagaatgttgctaactgtggacagaggtcccaatcacccagattcattattctttgttcattctaatgttgatactgtgtttctccctcaggaaggccctagctttcttcagcccttgggtcagggtataactgaagcatttgaacataatcaagcatatgtttgaccactttgctgactgtattgaaaaaaccctcaccttactctgaaagaagcatggcaacagtacaatattgccgatgctttggtagtgataaaagaggtgatgggtgatataaaatcagccactcttaagcttgctggaaactgtgggaggatgtgtgaatgatgcatatttccctagagctaatgaagaagttaaaaaaaatcttagtgtctgcaaaacaggtgggtttaagatttattgatattagggaaagtgaaattaatgagctactcaagtttctgtctttggtcatcactgagagtctatttccataggaagaagtctttgcagaggaaattgaatgctgtctgatgctacaattcatatggatcctttcctggattgaagcctgacttttaaaaaaggtttcaataaattgcttatacctatgaagagatgcaaaagaaccttcaaaataaagcaaaggacttgaagaaagagaaggaagacatgaagaagaggatgtcatttaggtgaaggtgatggatacagaatctgagtctgaggggagcctggttgacagagagacaaaaaaagaaattttttttttctgactaaaaaaaaaaaggaaattttgttaacaaaatcaagaatttaaaaaaaatgctgtgagagctgatctatgcatctggtttgtgagccagtattctgtgatggctgcagtttttagagatcctagtagctctacacatctgtcttctgctttcctagaacctgggcaccccatggatgactcactgctggttttgtgtgtgtgtgtgtgtgatttaaaattacattcagtcaactctatagccctatgggctttttgaataaccaaatgctcaacagttctgtaatctttcaggttgctgtgatcagtccccaaggagtctacactctcaaagagactgggaaaggcctgtgagacaatgggattcttttttctagaggtgtaactctgcctgtgtttgcatgccacctccagaaccactaaaatataatttctcagtgggtgactgagtaagactggcagcaattgcaaaagcagattcatgccatgtgtcactcttcacagtcaggaacttatttacctcttggaactttccaaaggaacgatgatggtggcggtaatgtcacattagtatggagcccttaaattcagcagtgttcaacctgagggaagacagagtaggtcaattctcttggcagcagctgagggaaggagagagcagggagcagggctcagataaggtttgtttggcagggtccaagcacttcatggaatggagacctttggctgtcagagatctgaggaagatttgtcagggcctgctacactctgagggcttgcagtttggatggttgggaacacttcttccttgcactgatggtgctcctatttctatgacacgtgtactagttcagacacaatttattgtgttcaccaattctatgcacagcaatcagactgagattgaaatccagtataatattaaaggtgatctgggccaggcgcagtggctcatacttgtaatcccagcactttgggacgctgagttagggggatcacttgaggccaggagtttgggaccagcctgggccagaaaatgagaccccatctgtaaaaaaaaattttttttaggttagccaggcatggtggtgcatgcttgtagtcctagctacttgggacactaaagtgggaggattgcatgagcccaggagttcgaggctgtagtgagctaagattgtgcctctgcactccagcctgggtgacagagcaagactctgtctctaaaacacacacacaaacaacatctgacaaggcatttcagcctggagtcagtcaaaaaatcttagaggtctgtaaaggagatgactatgctgttagggctgtggtagaaacctttaataacaagtgaaaagagcttgtatttgccaaaatgaacacaggatatgattctttttttgcttttgctttggagttgtatcagctctgtgcggtcacatgggtatctacaaatcaaagcacccatcaaccagatgcatctctgagagttaacagcagaaggtggcataataaaagaagttctcggtagtgaaaaaggttggaaaccaccagctaaaccaatcctcttgtaccaataggagattcaagttgagaggtgggaaagggcctatctcagagtaggtgcttgaatacttcttactagaatgaaagaaggaacttaagatcacacagccatgttactgcaggacggggaatggaacctaggtcttcttatttttggttcagtgttaactcccattctctaagcagactgggcctgttattcaaactgccttcccataggtgcttccctgcttctctcctcacccagagaaggacttacaaacagcttatcttcagaggttttgtgcctgatagttatggaatgtgctggtttgagcagggaggatgtaaggggagggaatgctaaaagcctgtctacttagagtcaggtttcctgggtaagtccctggaaccccatccccttcccctttcttgagaccccaggacttgctccagtaactgccaccctgtgcctttgcttcagggccatgctggataaggagctggctgcctctgtgaacatcctactcaaggcatcttcactgtgagttttgctgttgccattggagggggagtggggggagtgtggggagtgctagggtcaggtcctggctggtgtaaagaacactgaattaaaggaattgtcagaataactcaaaggcatttagataatcaacagtccatttcagtgtttttattcagagatcgatcgatcagtgggatgttgtccaacaaaagcaaaaatagactgtatagagaaggaaggaaaaactgcataatttaggaacagtatatcttgtttgcacattctttggttaaatcaattagcctgctgttaggaaggaagtctgggcattttatccttgagtaaaccaactagggatatcagagaaaacagtttccaatgcttttggattctccagaaaacagacagtttagcatatatgacaggctgcttctgcgtattgtctacctttcatttcattaacaacttcactttagaagcctggtctgcaccatttccctcatcacaatactttagcatcctggcactagctgtgcaggatttgtcgtacgtcttcctttccctgatgatcatgtttctcatttccttccctctctcccttacaccctcaaaagagagagacataatatacattctcaaggtcatataagctatataatgaaagctacctttttctccccagtgatgttatttcctcagtggctcacaccatctgtagtcatagttcccaaatttggccatgcggtctatccctgaactccagcctcaatctattcaattagtcgccctgaggatggggcccaggtctctgaatttttaaagacttgtatagataagtcacatttagccagtctgggaaccagtgttgggaaattgaatagaatttcatcctactatttcctttatatgcccatcctttctcgtgatgtattattttgccacagtcctgtgacacaggaagggccagtggccttggtcatcttagatttgcccttgttgatcttctcagggtaaatgtctttcctttcccctgatggtgttcttatactgtcttctgatcatcatttctgactttgttttcagcatctaaaagtttccataactataaggcttacttcttccctgcagtcttccgtgtttttagttattcatttatgggcactctccttggaaagtcagtgatcaaaatagcactagtgtgtaggatgagcactggaagagctcaagcagagaagacataggagtttctgcagggctgtcctggggtggttcttgatgaggccagttggggaaaaagctaggtggcagatgttggcacactataagaaaaagcatcttgtgaaaacctttaagttagatggacttcatcaagagatgatgaacctcccacctccaggaatgttcaggcaaatgccagatgcatgcattggaatcgttggaccagatgacatgtgaggccttggtcaactctagacttgtttatataggcttggaaagattttaaagttttctcctcagtaggtcacttaggtgggccaggtttgacacttcactgagctcctcttaggagcatcataatttggttttgttcccttctccaggtacttttgggagggaaaaatagaagccactaacatcctgttagtgaggatgtgagtgtagggagtctttttttttttcttttttttttgagacggagtctcactctgttgtccaggctggaatgcagcggcatgatctcagctcactacagcctctgtgtcccgggttaaagcgattctcctgtttcagcctcccaagtagttgggattacaggtgcccgccaccatgcccggcttattattttttttgtctttattttttggtagagacagagttttgctatgttggccaggctggtcttcaactcctggactcaagtgatccacctgcctcgccctcctacagtgctgggatataggcatgagccaccacacccagcctgttgtttgttttttcttttcttttcttttttttttttttaaccattagtgcaaatgtcaacatagtaaaaggataaataataaaataatattgttatgaaagtagttttgaccccatggaccccctagagtcctggagatccccatgggtcagtggaccttcactttgagaacctctagtataaacctttatcattcagaagtggaatttttggaattggcatcacctgggagctttcaagaactgtagaatctcctgctcaccccagacctaccgaatcaaattatagtttaacaagacccccaggggatttctgtgcacattaaatcttgagaagcactggtctaaaccagtgtttctcaccgctggctgctatgtattagcatcacttggaaacatttttcaaactaccaatttaggccccacctcacagatttcgacttaatttggccagggcggggatcaagtatagtggtactaaaaagcacctttctttttagatgactctaacgtggtcacctgaaccttctgaggttgactctaacgtagggccagagatgcaaaccacctatatggatgatgaaaccttttctttactccttagggaactaagattctgtgaatacaccgttcccctgggtctcaaactagctctagaggaggccctcatgataccacctcagcagaggtgagagagtaaggaaccattggtagagccagtactgtggagaaattaaaatttaactggtgagggacagcttcagggttaagagagttggacctcctaccttgaaacctggctccccacctgccactgttccatagtgcttggaaaatatgaatattttatgtgcctcagttgccccttctgtaaaattgggattatactaatgggttgttatgcatatggaaattaatatgtgaaacctgtacatgaaatgctttatcagtctcagctcttattcctaatgtgttaaaaatgtctttgaattctgtatgtctgcttataaaaacacataagttaacaaaattcattatcctcaggcacccaacgtacagaatatttaagcatacatttgaagcaacatgtgaatgtatacatatgctgtgatttattaagcatgttacgggaactttaaaacacctcattcagcagaaaggaggcagaggattataatcctcatttgacagatgggacactgaggcccaagtcctcatgttccttcagtctagaaagtgaagagaacttgcactgtgtgacaagggccaggcgaaagacacaggagaggaagatagattcctgtagaccttgtttgtcagggaagatcccttgggaaaggtcagtggttgaattggaccttgagggacagagaagtttttttttttttaagcaagaataggcttttgattgatcagcaggagcaggtggaatctaggtgggcaaaagaatacagagatactgggggaggggggattgttttgggaagtgatgtgtataggataataataaaaagagtagctcacatgtaatgaatgcatacagtgccagctggtatactgggtaagtgctttgtataccttgtgttaattaatcctcagcagtccagtcatgtagggccttttttttttttttaaaaataggagcatttaaagaaaactaagtgacttgtccatagtcagacagctagtaggggcaaagttagaatttgaacccatgtctgtgagactctaaagctatctggcctaactggccacttattgacagatgggaaacataggctagggagtgacaggccgtgggcctggacaggtggggtgcggcaggttgcagagggcctcccttgaggctggccagttgggttttatcacgagttgattctaatcatagtcacttatagggctttgctttctctccaaaggctgtacatccttttgaaatcccagagatcttcagtctccctgtggattaaggagatgtgcagtatttaaagtggcttcaggaaggcatggaagaggactgagtggggaaagctttttgtgcatgctgctggctacctccagcggctgcctccagcctccatcagctgcactctggggaagaggaggctgccttctacctcccagcatctctggatttcatgttcctgtcagcacagaggagctaaatggcctgtagaggctgaaggtctgaggctcctaaagctggaagaaaaggctgggccagtcaggccaagcaagaacacagtgtaacttgtctctgagtgcttcatggttaagggggctaagcaggcacaagggcatgaggatggttatatgtacagactgaggggaagaagcagtgaagatgagacttgccatcttcttgagtcagtaggcctgcctcaggtgcctaggatgtaattgctctgctgcttctcatggggaggagtggccctcatgaccttgtttacctggaagagtgtgggatgaatgcctcctcctatggggactcgcaagtgctttagcaaaaggataaattgctaattgtggcatttcgtggatcagcaggattatttctccttgctaaagaggattttgttggtcctgaattctgaggaggtgggactaggaatgggctccatgagcctgtgtatgactcagggaatattaggactttggcacagcctcatgggttgggagtaagtcttggctcttccctagcctgaatgacagacatcagatcattctggtgctttgtccatgaagatgtagattctgagcccacccaactaatcttttcacttgagcacagaaacagccccgggaatcggacagacccgtgtctttcaggtttgcttcacagagccccaggggttgacaataggtgccttggagactgcctgcatggggatttttaaaaagctttctttgttaaaggtttgtaaaccactcctctgagcctgttttcattttatagattattcagggaactgaactgcacagagatccagaaagtgggtagtgcaggctgtagtgctgataactactgtactacttggatctttgtgctcccaaataccaaatggaagaggatctctgagagtcctttgcaaagatcttgtagggactttaggctggggccttcggaaaattccagaggattccaatggagattttgagggactgactcagaagaacaaagagaatgataatggtgatgtccctgctttttacaacagatcatgttctgatatatatgcaaatctgtgtaaagtaaaccctacctaaaatgtactggggacccaagatggactgcctgtattgcttccaggataaagtccaatttctagctctggtttttataaccttgcttcagctcaccttttccgtcatcatcccctccatctcctctcccacgctgggaaatggatggctgcactatactgtgtgatgttattgctatgttcatgccatcccctctgcctggaatgcccttctgcatgaatgcctgtgaaatgttgttgctcctttgtatggcctggcttccgtggttggcaggaatctcttctttcgtggtattcctgtcatctttgtgcatcacagtcagctttgtattcctagcttgtaagct

SEQ ID NO: 85 - DNA, 43677 bp, Homo sapiens
aaattagaaaccagtaaagtgacactgaaggagcaacagcaccagctggaaaaggaattaacagaccagaaaagcaaactggaccaagtgctctcaaaggtgctggcagctgaagagcgtgttaggactctgcaggaagaggagaggtggtgtgagagcctggagaagacactctcccaaactagtatgtattctggaacttctcactgggagatggggtatggattggctctgctggttgtcttgcaaaagtatttaaagagatccggaccccagccagagcccaggagaggaggcaggagaagtaaagcaggaggtatgatagccctgtgaaagatgaggaagcaggttcagaggagatacaatcctgagactgaccagcaagtccttccttgctcatattgtctcctttgagaatgccatctcaagaaagtggaacattcacgtgaataattgccaaaagatactcttaaagtatattacctatgagctttgggaataatgatctacttcatctcaagtgtcaaaaaaatcatattaacagttcttttgtccagatttggcatagtgaatggtaccagaatacaggtgtttgcttttaggtcagtttgttctctcttgaaccatatataaatgaagttgacgtgggaatccagggtaaatgattgttctcacatcagtaaatggtttttctctttcttaggctccagggtttaataatgcttggaaaatgttgtgggcttggggatctgaaagggttgttattcctttttccctgggaactcttgatatacccagacccaatcatttcattatgaaaatgaaacttaaaaaaatatgtcgagttctgatcatgccagagttgttgaaaagtaaaatctgggcagggtgctcctctagggtgataagaaaaatattttttaaatgtcacttttatttcgtaagcattatctgtcgagtactcactatgtaccaggcgtttgcacacattattccaattgaacatcaggaaatgttttcctcttctataaaatggggctcatgccagtgtaggagccagctccaaatcctgtgcactttccactgcactgcctcctgtggaaggaagtagtactggtgtgtctccctttatgaaaatcaatgtttataaaaaacatttcagctgttccacacacttcaggattggtgctgggtttcctctcactggtctcaaagacttgaaagagaagatagtagctatctgtcactctgggatcaggccctccaggaaccaattacttcaaaaggcacccttatctgggttttttctgggcctttggtgtgggtcagggtaggcttgtacgactttgtaatggaggaaagcacctgcatgggtagcatatcaccattatgcatctgccacaagggaaggggagctctgcccacagctggctcggggtctttggctaaacctactgaaaatgctcatttcagaacggcagctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagcggagccagctggagaaaaaccttcttgtgagtacctgctgccgtggcagtttgtgaggaaatgataaatttaaaattttaaactgcaacaccacttcaacacagagaaaataaattacccatcaacccagtcctgaacccagctgttgttattgatgtatttatgcatcatttgtccttgaagttgatggtaagttttacctgggacgggtgcagcctcaatggagctctggctggctggggagactgttggtgtgaacagccattatcagcacaaagtagacagcatgttctgccagcaagcctcagtttacacctccactggcagggaggagggggtgttgaagaagccttctctagacggttgttttttaagatggcatcttgctttgtctcccatgctagattgagtggcgcaatctcagctcactgcagcctctgcttcctgggttcaagcgattctcatgcctcagcctcctgagtagctgggactacaggtgtgcgccaccacgcccgactaatttttgtatttttagtagagatggggtttcaccaggttgaccaggctagtcctgaactcctgacctcaggtgatccacctgcctcagcctcccaaggtgctgggattacaggcatgagctaccgtgcctggctcatagagagtttatttttatttttattttcaagacagagtcttgctctgtcgcccagtctggagtgcagtggcatgatctcagttcactgcaacctccacctcccaggttcaagcaattctcctgtctcagcctcctgagtatctggaattacaggcgtgtgccaccatgcctggataatttttgtatttttagtagagacggggttcaccatgttggccaggctggtcttgcactcctgaccttgtgatccacacgacttggcctcccaaagtgctgggattacaggcataagccaccgcgcctagccagttttattacactgctgtagtcagtgcctacaaatttttctcatcctgccctttttggccaacattagctttaatcattatcctaaaaccaggaagctcaatctaccatgctttcatccttgaaataaatttgggaagtgacactcaggtcagaataatttatggtggatggagacaggtgagcagcaatggaactgtcaagggggaggatttttccactaccctctggaggggttagtggagccctgttgtatgaaaggaacttttaaaccatgtgtgtctctcaaaggggatacgctgataactagtgataggcagatcgtcataaagatggaatatagatgtctaaaatttaatcctaccagtaaccctgtgatgatgggtattattattctcattttacagacaattaatgaagactcagaaagggatagtagcttattatcaaaggtaatgctaacagactctgacgtgtatatacgcccagctgtatttgatctgcccatgaaaggccgatagaattatccccatttgacagctagagaagctgaggcccagaaggggaatgaagttatagagctagtgagtgtgtaagccagcaaaccacacctccatgtgttagatcgcagagttattttcttcctcctgtgctaggagcaaaaacaggagaacagctgcatacaaaaggaaatggcaacaattgaactggtagcccaggacaaccatgagcgggccaggcgcctgatgaaggagctcaaccagatgcagtatgagtacacggagctcaagaaacaggtgtgtgcccagaaagcccagctggccagcctggggagagaggactcactgggctcaggcagattgtattgtttttaatatcccttctatagtagtatagaaaagctgattataagaatgttctttaagtcaaatctggttttttagccttaaaatttagaaacacaccttgactattaaaaatataaatttctcttaaatttgacaagctcttaaaatgttagtttttcaaggaaaaaaggtaattcttgagcatcatatttcatgtcccaaagaactatgttgaaatgctagattttatgccataaacaagtctataggagccaaaacctcccctaccccttgagcaagaaaagatggtccgggggaaacctttgatatcacataatgtagccaggcagagagtattaaaccagttcatgcctggactggtagagtctctaatccttgatatctctggtgtcctttagagcatctgggccatccctgaactctagtcgggctgctgtagccactcatttggccctgctatacttagtcttttgggtgaccccacgtggccattctagtttcatctgtgcttccaatcccctgatgccccacatatacccaccatttaattcaagaaaaaataaccaaaaaaaaattatttaaagaccacaagcccttagtgattttgcctttgcaaatttggtaaggcaattagcagtaggtataaatttcatatttcactaagctctatatggggtagagccacatagagtagtctcaggcatcaaatgcagttggtaacactttaagaaacctctaggctgggtgcggtgctgcattcctgtaatcccagcactttaggaggccaagataggtggatcgcttgagctcaggagttcaagaccagcctgggaaacatgccgagaccccgtctctactaaaaatacaaaaagtagctaggtgtggtggtgtacacctgtagtcccagctattcgggaggctgaggggggaggattgcttgagcctgggaggttgagactgcagtgagccaagattgtgccaccgccctccagcctgggtgacagagcaagaccctgtctttaaaaaaacaaaacaaaacaaaaatgtatattgccaagccaccagattcttcacttataaaattccagcattagcatttataatccagatcacttatgacttatttcagtaaatggcccttttctcatttgtggcttatttactctagttgccagttgggtgccactgaggtgcttcatgtaaattctcacttagtttttacatttctgagcagaaggtatttatctccatgtataaatgaggtaatggaggatcagatgttagccaacttgccctgtcatactggtaatactggaaatcagattggtaactagctttgtctgactccaaagagattgtcttctatagagtaattcaccttcaaggaactttatgcacatggcttttctaaatgaaagttgttccagttaaaatgccaataaaataatttattcagtagcttatagagtcttgagtatctgaaaaatcacaagtttttacagttctagtaatcatagtagttgatatttatagatctttaaatacatggcacatcatacagctcaattccaagtaagtctgaaattttatacaatgatatttgacaccaactcactgtttagatggcaaaccaaaaagatttggagagaagacaaatggaaatcagtgatgcaatgaggacacttaaatctgaggtgaaggatgaaatcagaaccagcttgaagaatcttaatcagtttcttccagaactaccagcagatctagaagctattttggaaagaaacgaaaacctagaaggagaattggaaagcttgaaagagaaccttccatttaccatgaatgagggaccttttgaagaaaaactgaacttttcccaagttcacataatggtaagggtttatcctgctattctctgggttcgtaggattgaccacctcccccagctaagctaaaacacagatgtgggggtgctggggtaggggagggaaaggctggttggcttccatttgtagcagcagatgattcatgatatctctattttccctctgagaaaggatgaacactggcgtggagaagcactccgggagaaactgcgtcaccgggaagaccgactcaaggttgccctttaaaacaaacaaaaaatcagtatgagatactgggcacattggggaggggaggggaaagttacatttacctgatgctttcacatccatgctgttgcagccctgccagcagtgtcagggatggcatgtctgaagcttcgaggagttggtgtcacacagtaaatggcaatcagtgttcaaaaccatgacttcttgtgttgactccagtgttctttaacctatgtaatgctgctttacctcagctagaaccgatagaatctaagtatttgggagaggaagtagaaacacagtgatgaactgtaaggttatcataggccagtggtggcaggaaagatttgggatactggaaaagtaggctgaatgtcaggtaaggaattgtttggctcagaacatgttgactttgaaggccttgtgagatatccagggaaggatatctgtctgtaggcagccaaaaataggagtctaggattactgatcagtgttgacctaaagatttgagagttaagagtataggtgggaggttacatttatgtggggggaatggctatgtagacagcatgggatgagagagtgcagtgctatagtattgagtggagccctgtgatgtccaacaatagtctccagccatgtgtggttatttaaattttaataaattataattaagttaaaaattcagttattcatttgccacatttcaagtgcttaatagccacatgtgtctagtggcttctatatttatagccagaggtagaacattcccatcattgcagaaagttctgttggacagcgctgctatagactttgagagaataatttgattatagcaggggcaaaagccaaaaagtagtatgaagttgaggattaaatacctaatcatttatagacaagaaactaagacttaggaaaaaatacataatcaggagacactccagttgtcaagtataaactgatcttctcagtcataacagaaaaggaaaaaagagatgaggcaataatttaatggagaagcaagggatacagaaatcctaagcactgctagcatggaaaaactgggccaagtgaaagaccccgttaatgacaacacagaaaagtaaaggtttatgcacactaagtatccacctggcacctcctacaattctttttaaagatgagcatttttgacagccattcctactgttagccagatttgcctatcaaatgtatgtgaggaagctgagcggcagttctggtacatttcttctgtgtaaaaccctaagtcttatcacacttttcaggcccaactccgacactgtatgtccaagcaagcagaagtattaattaaaggaaagcggcagacagagggcactttacacagtttgaggagacaagtagatgctttaggggaattggtcaccagcacctctgcagattcagcgtcatcacccagtctgtctcagctggagtcttccctcacagaggactctcaacttggacaaaatcaggtaagcagcagctctttttaaaaacaaaacaatagcctgaggttgttttttgtcttttttgagacaaggtcttgccctaccgcccaggctggagtgcattggtaccatcacagctcactgcagccttgacctcccaggctcaagtgatcctcccacctcagcctcccatgtagctgggactacaggcacacaccacttggcttggccactttttaaaattttttgtagagatggaggtcttgctgggttgccagggctggtctcaaactcctgggctcaagcgatcctcctgcctcggcctcccaaaatgctgggattacaggcgtgagccaccacgctgagccaagaggaaactcgtaagataggatttaatatattacatagaaagtacttaaaagccgtggggtgtataatctagaggagattcagaaaaatatagattatgccgccttcaactctctgaaaaacttgtcttagcaaagacttggtagaggtagataagctgatggcttaggaaacagactacgactgcagattggatgacctggcagggatatagttaattctactattcatgtcctccacttctggatttatttatttcctactctgtcaatataaagagcttagacctgtgaggccaatatgagtcctagtttagtatgtctccctgcattttgtaacttacatttacagagttggaattcagacctcttaacctaaggtctataaaaaccctgaatttcacaaaggttttctgtgtgagcttagataaggttaataagcatttaagaggaacatgaaatatactcatggaactggtaagtagtagcacacacaactgtcagagataggtaacagcttccattttccagtgcctattgtgtgcacatacaaaactttatatatatcatctaatttttacatccttggaggtaggacttatccttttatatagataaggaatctgtacaaaatgataaatgatttggtcaaggacatagcaaaggacaacagcaggacttgcgggctaatctatctttaccacagagcagtatattttaatggtggagccacaaggagctttcaaggacagttgcctctttaatgtgcccaaggtgggcaagtgacttacctagttcacacagctaattagcagcagggccattagcagcagggccatctgaatatgattatcttaacaccatctgtggtggacccagtcaggtaaaggccaaaatcatcatgggccttagggcagggttcgaggaggagtgtgagaggcactgggcattgaatagggaagctttggggatgagacagcccagagtagtgagagaagagtagagtgcacaagggcttaaaagccagcttcaattaccagctcaaggtggcagccagagttatttagttgctttaaaggcaaccaacgcacagtgggtaggggcgagattggtagaattatttagaagtctggggttgtaatccaggcctatatgggataaaagcctgaactagttaaaagttagggggctggcttctgagcgtaacattttatttccctttttttctggtaagaacagatactacacttgatcttagtcaaaaggctgagagctccttccagcaagttctgcaaggtccatcagaaccactagacagttactgacactgatgccatccctgctcacaggatagatgttacagatttttttttaaactagaacttttaattggaggatcttgaattttagcagttttaagaataaccgtttaattttttctctcagaattttgtacactggttcatcttaaaacatttttccaaagaggtactcaaatatgtcatttacctataagccatcatgccatcacttagttaagactgtttttactgtttcaagaatttgatttatccttccttttgtcttactgtaggaaaagaatgcctcagccagatgaggaatactgtcttgtgtaaatatattcaaggaaaacacctccactacctcactgacttcataattggaatgtcacatggtttttttaatcaagatgcagtgaactgagattctgaaactccactgtagtttactttgcctgtaccattaatgccaatgtttttataaatcacttgtacatagtacatatgggaatagttgcatatgggaatttaaaccaacatgtggctgagcctttttttttttaatcttcgtaacatgtttaaaaaaaaacagtgattttaactgcatatttgaacctacaaactggtaaatcttattaacaaaaagaatgtacttaaggccctctttatttatagtgtcgagttatttttgaattttgcttaaaatctatttttcatatgaaaataaaagataacaatcaacttgggtctgtcctctgactttacacttcacaggtcattctatggaaaagccgtcaaatttttaccttattccaagtaagtaatctttcaggtggttttcttttacctggaggctgaagtacattatacttatcaatgaagatttcatcatttggaaatacatcaattataaaactattatgcttcagatgcctttccttagccaacatattctttggtggaaaatcaggaaaactttgtaccttggagaatgtgacccagtgataaattcaaattgtgttgcctttcagattttgaactaccataattaacagctcaactccatgatgtatacatttctttaaaaactagaatagcaactgctctcacagtctggcataattattcccaagggggaaatatgtaataagaagttttaaaatattctcgggaactcttttctagatcactactagacagcttttgagtcacaacaggtatgttaccctgttactaataatacagagcagcacagtgcagtcatccctcaccaccaaggtttttattccaaaacagttatttggctagacgtgaaccgttaagatacgggatcaatggagttacaataaagacaatgaaagtgacaatttattaatacacagtaagttctagaaggcatctttcaaaacaaaacttgatttcttttgtatttacattttttgtttcaagtcttagcaaaatgctaaaaggcctggcctagtcacaattactgacatccttctgggacacaattttctgggcctgtgttgaatgaggataaattatcttttctctaaaatgccacatgaaccctctctatattcccacatgaagaggaatggaaggtaattatttggtcttttcttctgtttaggggaatgaactgaaccactcatttttttaaaatcacacttaaaagacacatgggcaaaaaagttccccaaaactactgtcttaccgaatttgagaagggaggtaatgtatgaagcttaacagctggcttcaaaagacacctttccaaagaaattgtactacctctattaacgtgtaaaccaccaaccaaaaaaaaataataagttactccatcaaacacgttattatccataaaaaagacttcaacattgtactggaagatctatttaagcataaatagtactaagcaccaattactaatctgaaggcctcctcacaggtccaagggcaatgagcaacctcaagaggcaggtgactgcacaagcagtaagctatggattaaaaattaaaaggatttcacattctttccaaagtgtactgcccggtgtctggcacacgcatgttacaatatgacaatctgctctatttgtgagcacctgagtgtattacaggggattacacatgcatatgatagaatctggctcccggtacagtcaaaggagaacagcatcagccaccaaatgtgctgatcttacactgaaaagggttgactgaaaacatttcaagggtaatgtaaacacaagaataaagctgtgggtctattacttagtgatgtggttttatatgctacatacgtagacctctctttatacaatgaatatggacagtgctgcaataaaaactgatgacacgtcaaattgttcacctgaagaaaaaccctattatagttcagaaaataatgcaaccaattttaatttaatctagatacaggtactttatttacaaatatttagattaatagcattttgttacatcaaatgaagagtacagcagtctgaataaatccttcagtcacaaaaacaataaaacccactgtaactaactttgggagtcagggtattgcacctcaacaagccgcagtctttagtttgtgattgctaccttatatcccaatgggtggtttgtttgttttgtttttgtaaatatacacacacaccagcaggtcatggtccctgggtgagtcccttgtgatgcaacagtgtaagcaaaatggatcactgtaagtctttaacagaatataccaatctactccagaaatcttattttttaaaaagttaaacaaagacaaaaataaaaatgaatccacaaattaaccaaagcctactttctgcacattccagttttggcttttatttaacattgactatacaatactctggtactaccacatgtttacaacccagaaagatgtacttttatgttagtgtctgtaaagagggatttaaaatgtgtattttaaacacagcagttgagctgagtgcattttctatagtacgctgaggtgttacctattctatttcaaataaattctcaattcccagccactgaatcataaatgcaataaaaaaaatcaacagaaatgaagaacttaataaaacatgttgtccaaaaaaataagattgtttctcttgctatacagtattaattcagtggccaaaccacctggtgcaaagtaataacttactttgtatcagcacaagcgctgaaacacctttagaaacactttcccttttacaaaacaatttatgccaacatgacataaaacagcccctcacactgtgaacacagggatatcttaagttatttcactgtagggttaaaaatgcacaatttaaaatcccttaacagcagacctgtggttctgactgtccagttcagaatctgaccattccaagaagataaaggtataaaagcttaaaatgtgcaatagtaaacccagccttttttctttttctatacagtaaggcaagaatgcagcctgtaatgcaaaaacgtttacaaaaagagaaaagcaggttagcacattgtcgattgcacaagaacagttaagaaaatcagcaggtaagcaacagtgcaaagatggaacagaatctgctagtgttaatcctctgatgctaggagctctttccagcataatgtccccaaacactgccagcaccaaggggtggagccagtactacttgtgaactgcagttgtgtctatttctttgtgtgaaatggaagggagtaacatggtcacatataggtcatactgtacaaactggtattttatactgttccaatgccagtaatcaatttattttcttcattaaaataatatacacagaatgtattgttagttcgattccttcaaattttatacatatttactttctgttaaagagaaaaggataaaatggtataaaaaaagataaagctattaattaagcacgagagagaagataaatggatattttccctgtgtgaggctaagacagaagcaaatctcgttaagaaaaatgccacccacacaacaggaaatttatccaaaacaaaacaaaagcagttatagaaccccttctctaccatcagaagtaatttcacagcaataaacttattggttacaacagacatacttgaacagttaaggatgggaagaaaggcttaagatatcaccaaattaaaccgtacagtgagacaaagccttgccaaagggagggtaaaaatcatgaagtccagcatcagtgctcggtttaaatcatatattggtgacatacttatcacgaggacaagggggaaaaaaagtctagatttaccatgcaggagagatttattactctacttgcctttgataacctgattacatctagttgtttagcagtttagtattgtgttaaactgtttttacaacagagttttttctttttttttaattaaacccagtaagatgtacagaagacaatgaggcagtaaaaagtactgcttccaacagacagaggtgaaaggtcaaatgaggggccacagcaaagaggtcactagcagccacagccttctctctggggttggggttcactggttagccggcctccctgcggggctgaaggtttgtgttgtacaccagactcagcagcattcagatccaagcttccatcctgaatgttctgatagattttcttggcagcctcaaggaaggcatcttctacattctctcccctaagaggcaattgataactttattggagaaccacagttttctacaaaagacaagacactgaccttttgctaatctttagttaactgccatgatgtctccaacttaaccactgtcatctaataagagattaccagaacactgagctaagagaacatggaaaactattttccttttttttttttttttttttttgagacagagactcactctgtcaccaggctggagtgcagtggcccgatctcagctcactgcaacctccacctcccaagttcaagcgattctcctgcttcagcctcccgagtagctgggactacaggagcacaccaccacgcccagctaatttttgtatttttagtaaagacagggtttcaccatgttggccagggtggtctcgatctcctgacctcgtgatccgcctgccttggcttcccaaagtgctgggattacaggtatgagccaccacacccggccggaaaactactttctatggaaagcatacatacatacgtgtactgaaagccctttctacaaaccctatttggacaactacatgtgttatatgcaatcattaaaatactgtatgttaatacacaccatgacaattcagataggtcatttctgtgataacagagaggatactccaaacagaaatgaaatctctctgaacatgctgaaaaaaattccaagaataatatggtctgctcagccaagcatgaactgagctgtttttaatcgggtaatggtgacataatcatgcttagccacgttaacacctccattcagttttctttggactaatagcacagctgagactaaacgaaaacaggttagcctctcctcaccacaagaaatttttggcctaataaatgaagaacaatgatgggtgtaccacagttcaatagcagacatggaagaacaattagaaaatgttcactatgcttctgagtagacactattcccttaaatcatgctttttaatgtgatcagaagtattacaggaagaacagattgaccaagcttgtctgagatgccaaactcaacctcacttgtgaaaagtcaaacactgtcatttgggaaaagtcaaacacttttgaaatgtaaacaaagtttcatttattaacctgggttaccaacaggcataatcaaggtacaatcttttaagtaacaaaaattcatattattttgaaatgtaaaaaaggaagcaaagagatgtttgctgttcttcctgcagtaagcattacacatttatagatagtactttatatgtgtatatacattatatacttttcatatatacggttctactttgagaaacttgaatataattgaaatatctgtattttggtcacacttacgtttttgcactcgcttcgaggaacaataagcctaaaaataaaattcagactataattaggacacttcaaactaactcacaagtgcacttctttagtaacatctgaaaaagtttcccatcagtttttagtactcctcccatagtattttatgaaaaagtatgtaagtttgaggtggagagcatctttatatttgtcactaaataactgtactgctccaacataaatcacacagaaatagaaacacattgttacttcctcattcttgagatttctgagtctgcatttaaaaaaaaaatgcaaaaaaaaaccaacaaaactgtcaagcccacctttccttaaaaattctcccaattgtgaccattaagtcttaaagaaactcaccattttcttcagcaaactgtttggcttcttcatatgtaacatctctctgtgcctccaaatctgctttatttcctatgagaattattacctaatttgtgatcaaaagaaagacaccttgtaacaaaagcagtaatttaaaccaaccatgcaaattctgaaatccaaaaatcttgatagaaaaaatgactgggcctaaaaagaaaaccaagtactagcaattatccactagacagggctacagattcatgaagtcattactacaaaggaccttagcaatgatctaggtcaggggttgacaaactttctgtaaagaataaatactatattcttcaggtttgtgggcctcatatggtctctgttacatgttcgttgctgggtttttttgttgttgtttttaacaaccctttaaaaatttaaaaatcatccttagttcacaagccagtcaaaaacaggctgtgggctgaatgtggcccacaggccatacatactttggtgacacctggtctagtccaaagattacgatatagctgagtaagattactaagggttcatggacaagctccaggggatctgtaaataccttgaaatactgtaaatactgtaattgtgggcattccctagaggagaagattcatggcttccatcaggttttcaaacagttctgagatcctcaaaaagtttgaaagccactaggttcaactcctttaggctatcagtaaggaaactgaagctcaaataaggcaaaaggacttgctgaaggtcactcagtgagtcagtggtaggaggacattagatctcaggtagaaacccaaactgagatcttgagacaaatactatcctaccccacactatccctagaaaggattgagtttatagttaacagtaactgataagagatgtctatgtgtatacacaaggggcagctgggagtaggggtttgggggcacgtatgcagtaagttcaaatccaaggcaaaatatcacccaccaacctatatccaccttggaaccattcatacaagtgaagttaggccaaagttaaaggcagctctgcaaagttgtaagaaaaaaatatgtacccttgggaaacagcaaagggctttggcctttacctggggtggggaggggggttatggataaactgtctttgtacatttatgagcttatttgacaccaactggtaaaatccttccctttttcccccttccaaacagatatggtaatctagatatgaacactttaggaatggatggtttcaactaaaaggcacttcagccattaactttttttcatgtaaaattacagctcctggctcttccactttcaaaaatgtgtgtccataaaccaaataatcatttttatctgaatgtaaacctcatgcaaggacagttaagtagtacaacaaaagtgagcattctttaaacagtgtggacaaagtgcccactgtgaaggggaagaaactttcatatactatccattagtattttaaaagaataaaataatgatacttaaaaaggaaatcaatttataaaaaatcaagtctggtaaagccacaatgactagcatagggccattacaagataggtactcaaaacaagaaatactgccctgctcctgattccctatgaatctccaaataaggcttcttatctccctgaaagggaagacataaagtggcatgctaattacagagatacaaaacatgcccacaacaaaatggtagagaacacaacttctacacagaaatcaagggcaattctatagaaaatggagcacttaagaaaaactcaagaaattttttttctcctgatctggttctatttcaaagcacataaatgaggcaggaaggacacagggcggtaaggttaattttattatactcctccacgggccctctacaatgagttttgtttttaatattttacttgaaatagctatagagtcacagagacttacaaaaaataacagtgaggtcctgtgtacccttcaccaaacttccctaatggtaggatgttatgtaactataatacactctcaaaaccaggaaactgacattggtacaatctgcagcccttattcagatttcagtttttacacattctcaggcacatgtgcgttcgtgcatgggtggttctatgtaattttatctcaggtgcagatctccatcatcactatcaggatacagaactgttctatcactacaaagaaactgcttctgtgctgccctctatgtcatcacaccactaccaccctccaccccctttgctaatccctggcaatcactaatctactccccatctctacaattttgtcattttgagaatgttttctaaatgaaatcatacagtatgtaaacttttgagattggcttttttactgggtatgatgcccttgagaaccagctcaactgctgcatatataaagaattcattcctacgtacggcttagtagtactccactatagagatgttccgaactgtttaaccattcacctgtcaatggccaggttgggaaacacctaggtttccagttctgggctactggaaataaagctgctatgaacacccatctataggtgtgtatgtaaaccttgggtttaatgcgataatggaaatgaaagtttcaggcacagtccctagcatgataggcaaacaatgttaactgactctcaatatgattaaaccaccatttcctgataaaagctcatcttaccactgataacacagttcttgaaggaggcctctaccaaatgttgggggtataaagccaagtgagacacaagccttgttcctgagaaactcaagtcacagctcagtgtgtctttcctcacattgttcctggcataccctcaacaatatctactgaaacttcactcacccctcaaggaccagctcaaacaccactcctctgtaaagctgctttctctccagacggcactgatcatcctaggctctccagcactgtgccagtccctctatttctaattcgtgcttcaatctactttgcagcacagttatctgcatatctgctggttctctccctgctagactataagctctttgggaccaaggatccatgtttatctttgtatactgcagagtctagcatggtggctagcctttaaaatctcaataaatatcatctcagtctggttaagaagctaatgttttaacacatatagaatcctttttatttttgactgaaatttttatccttaattctcctcctgtagttgaaatttttattgaggtaacgcagattcacatgcagttgtaaaaaacagtacagaaagatctcttctacgttttgcccagtatcctccaatgctaaagttttatgaaattaatgcagatcccttttaaaatcataatttcagatttcatagtcttcacatgagatcaccactacattcataatagtaatgacaaacatgaacaaaaaacctaggtataataaaatgcaaaacctggtttaataagaactgaaaaataactgttaggttttcttcaactaattgaagaatacaataaaaattctctcattcttagtacctgaagacaaaaatctcaccagtaaatggcttccctttttgggttagcttagttcttaaattttctgtgtaataagatgccatttaacttacagtatttggattggtgagattccttgcatctgtcaaccagctgcttaagtggttatatgtacttcttctgcaaaaataaaagtttaaatttgtgactgccatataattatagaaaaaaaacttaaatatttaaaatacatatttaatcaacatatcctaaaataataattttgctttgaccagttactcagaacagtagttgtgaaatacaactgcatacttttcaaaaatctagccaaacctaatatttttaaataaacaactcaatatccaacaactttgataattacaggtcaggagtaaattgtttactcctaaaagcataccgtaaacagaccaataagcaagcaaggaacaacacagtaaattgatggaaatgccaatgtggagtcaaaactcaaattactttgaaatcatacagactttcaatcacaaagcacaaagttgtatcaaaatgcctaaacatgacacatttaatggaagacacttttgcttgtctttaaattttaatttcattaaaaaccaagtcacactattataagctggcatacaattcacctttccttaataatttaaagagcaagctaactataacagcataaaattgactttgaagacatttgacaagaattcaagtccccagatatcagtgaaaaagttcgtcctaactttgttctcttatctatcaggcagctaaattattctggaattctaactgcccaagcaagagtttaaaaactcataggctcatttgcactagccaagtaagctctaagataagtaaacaaacccaaatatttgtaatatcatacacagtagaatctaccaaaggggtcaaagataataaaatttttgaggttaaaaatgtttctgatttatagactcacagaatgttagtctatcttactcgtttaacatgtgaggaaacggaagcccataaagacttaactggtgtcaaaatcaggcctagaactcttttacaaataccacatgtcctttaagtgtttctagtttagtcctgtgaatatattccatgatctctagctgccagttctcatagaaaatctgttattcaaagtatatagttctttcccaatgagaactgaaaagaactccttagtcagacttttattgtgttacatcatattattcataaatcaccacttagatgtcaaaaaagtcatatatatcaaaatagcccctttccccccaatgttttagaattttctaagtaaacaatgataaaatacaatttttaaaaagcacaagccttatctgtgtttgatattcgtattattggcatatcttgactttatacaacaggtatgttttactacttcatgcataaaccttaaacaagtccgaacatttctactgactttgatgaactttaaaatttcaaagctgacacagagagtgaagtacacagaaaagcctagtaccaaaatcatataaaccatattacttacatgtactataacttctgccaatgattctggtaattgttattaatttaatattcactataattataattttaaatctataaataaatattattcaaatattaattggtggtactagtactaaaaaaaaagtgctaaaatactagatatgtcaaaatgttatggcaaaacaactgtcacgacaagctacgctgtcaatttagaaaagcaccctgtaacaatgagagttaatgacaaaaataaaaagggacttttacgtttgtaaaatgtcaaagaataacagaaaaaaattgctgtcatgactgcaacaccaaagtcactataaagtatcactttagcgcctgactaaagcctcgggtactcttttccagtaacagtttttattacaatataatgaacatatcataaagcttattcttttaaagtacgtaatttagttgttttaaggatagttacaaacctgtgcactgatcaccactatctaattctagaacattttcatcaccccagagagaaactctgaactcacttagaagtcactcactcccatcctctggcaatccactttctttctctataaatttaccagaatataaattctcgatatttcataaatgaaatcatacagtatgtgtctcttagtgtctggtttcttccacttagcataatgttttcaagtttcatctatgttgtggcctgtatcagtatttccttcttccttatagctgagtaacatttcattgtatggatatatcacagtgtttatccattcatcagttgatgcatgttctggttgttcccagctgaagtactttttttgatgacttgaatagacacagattttaccaaaagtattaactatgcttaaaagatatgcttaaaagcaaaaacaatattcttagcacacatcaccatacttaaattttattgagtttttaattatgtgaagtcttcagaaatgcattccttataaaatcagacagttctgcgtaggcggccaggtttattaacagtcttcccataatactcttgatcatatcacagattgcctggctataatgaagggcattaaggcttgtttccctttgaggccacccaattctagaatttactgaaaactttaggcactataattataattagtcaatatctttattctaaggcagcatttcccaaagtgtgttcctcaataaaataagcttaggaaacaccaaattaaataaagtcatacagcaaagaatttcttactgcagaacttcccagagtcttaatatgctaacgcacattatgacacatcaagaggaaaccttttaaggcattttccgaaaggaaatatgctttaaactctaattatcacttggtcccactcgcccatctttacccccaagaaacagagtcacattgcttttgactggcactttacatcaacatgaaaggtgatccagttcattttctagcttacagtagacaaacagtgcagggtctaatcaagtggcacagttttccatgttctccaaagtcaaacctttatgtacagtagttttattactttacatcaagtgctttggaattccagaaacagtcatgttgaaataaatttaaacctactgcatgtagtatttgaagtcatttctatccattttaagagaaaaaaaaattagtaaataaatactcaaacaccttcagatgcaagcataaagttttttataatctaccatgctggactagcaaaactctttgcttggccttcttttgagaggtgtaaactttaacactagagactaaatagagtaagtcccaagagtgagttgcttgctttctacttaaaagaacattttatataaaatattatttctcctcaaatcattcaactgaagctgcttttcagaactgtattcttctattagcttcacccaataactaactccctaaatttttcttcagtcataaaaacttttggaaaatatcaatgtgttatatcaagttttacatggcaacttaagaaaccataaaaaacaagtaagttcattcacagtcatacaattacaaactaaaaaaaatgcctatcaatttttttttaaatgcccaaagtagatttattttccccatatgaaggttgaaaaattatctcttacctagtgatatcatagaccataagagctcccgcagctcctctgtagtagctccgtgtaacagccctaaatcgctcctgtcctgccgtatcccaaatctgcagttttattttttggccactaacttcgattattcttgtaccaaattcaacaccaattgtgtgaggacaatcagccataactgttaaggaggaaaaaaagtaatagcccaattttcagaaaacttcaaattaagcctagagggggaaaatccactaaataagcaaatggcttactaatacttacaggctataaatagactaaagctaccgctaaaaaaaaaattaacaaacacccagaagtaagaagtcagggaaatgtgactgtactagaatcggggtcagcaaacttctagaaaggaccaagcagaaaatattttaagttttgcaggtcaaaaggtctttgtcacaaactactcaactctgccactgaggcataaaagcagccagagacaatatgtaaaacaggcatggttgtattccaataaattttattcacaaaaacaggcagtgactggatttgccccactggccaccgtttgctgacccctcgactaaaataatctgctaagtaaaaataaggattttaattaattcttcacaatatcaacattataccatttagccttcttacaatcattatctataacagatcaatcaatggtcttggtaccctaggagttgttagtcaaacagattcttatcccagaaaatatcagtgtctcaaagaaaatcagcatgttttatatatatatgcatatattttagagacagggtcttgctctgtcacccatgttggagtgcagtagcacaagcatagctcactgtaacctcgaacttctgggttcaagcaagcctcccacgtaagtctcccaaagcactactgggattacaggcatgagccaccacacctggctaacatatactacttattatacaatgacaagttatatatgtctaagccaattaacaaatttattagtcctttccttataatgaggccacttaaaacctaaacccaccattctccagtacaaggacacagacttctgggcacttcataaaatgttacatcaaacctctgtggtaagcagcacaaaaatgtcaaagaaataatttcaactatacagaaacactttcaactatatttagcatatcagttacaacacattggtcccttctatcacccaagaaagagtagaaagaattccattttaagtatttcaaatctgttatttaacaaatgatacatgcagcaaatttctcctaataagacaatcaattcctgtaacagaaagtcagagaataaaaagattaagtttgacattattttatgtatttttaaaaattattttaacatcaagaaatcaaaacaagcaaatcagattatataatgtgtataaaaatcaaccctaaaatatgctggcatatttcattttatctgtacccatttaaaaaaagtacaaatatagggaaaggttatatttaaatgcatgaagtatactgaaaatgacactttctaaaaagtagaaacatggcgataaagaaaactattaatgtttacctcatgtattgaacttacattttttttctgtaaattgatgaagcaagcaagattttcctactcccatgtcccctgtttaaaaaaaaagaagtttcaggtggcaattacatttctcaattttatgcaatgatcgctatattccttaccatataacatatcacaagtttctgggacacttaacaaatttttattttcctactttataatgattcaaaagttttcactgtgagacacaaatggaatattattcccaatctttagcagtgacagaatttggctgtaaattattactgttaataaatagccaccagctgggaagtgcttatttttttaatggaattttttttactttgagctgtttcaaaattttatgtttttgttttcttttgtttttttccttaaactcatgcataaaagcaacaaatttcaaaaactgacaaatggggtagcatgtaacaagcagaaataacaaactgagttctggaagcttgattcactaggtccctgtcttatacttcttgtattattctatgaaagaaaagaatttgcattacatgaaaaccccaggagaaaagatgtcatctctgactgtactatagcaatgttaacccttgatgaaggaaacattagaaaggacacattaagttcaacatgaaagcaaactgttctaatgtgaacaattcattgaaaaacgtgtactttcaaatgtagttttatgtttggataaatagcattaagacttaatttgagcaaaaccttcttgaaacttaaggaaaaaaacaccaattaagaaaaatactatattttatatatattacacaattgatttggaatcaaacaatattctctaccaatttttccttataacagaaacccaggggaatctgagagctttcacagtattttaggaatgtttctgcactccttgaaacactgatacttcctagcatcaaaaagctttcaagcagccctcaagaacaatgaacatcacttcacaaggtacccaccagcactgtaccacagaaatatccatggccacaatgcaaaagctgcattgctaatgcaaaaataaatcttataaaaggagttttagttttacagtaagaaaatcactcagtcctgaagtggtactgtttaagtattaacatataaatattttgtatgttaaccttcttttgggaacaagagtgtaagttaaataaacttaccaataataatatatttaaagatgtaagagtagttgtatggtgcagttgccatggtggcactaaaaacaaagaaatctctgttacttcagaaggaaagcatatacaagtaattcaaacggatgactgatatcctttaaaggtagaaaaggacactgaatacaaacaaatgttggttacagtaagtcaaaataaaactgcatttcacaaactgatcaaatacacaaattctcttggatgaatgatgcttacacattctcatgtgctatccacagaaatataagaaaccatttataccacaactccaatatttcacttaatatccactagaacttaaaagtataatttaaaaaaaatccaataagtattaatctgaaaattgtcaaacaaaaaaatctttataaatttaagttaaacatcactatagtctcttctccccttaaagtccccttccctgttaactgatcaagtaagttactaatgatctacttgttcagaactctgatattaaacagaatggtatataaaggaaccacttaatttataaacacaaaacaacgtttttactctactttaaatcaacagttagcagcgcaaagagcaatcgtatgatttccaaatcaatgttggaactagactgaatcacatgaaactgttcttcctatagatttttcaagtcaaagtttattggcattttcatatagctcaacctaatacaggacttgcagattatcactcacacacacacacacacacacacacacacacacacattttttgaagaccaggctggtcttgggtcttgaactcctggccttaagcgtccctcccatctcagtctcccaaagtgctaggattacaggcatgagccactgtgcccagccagattaacaacatagtaagtgcttcccatacactattctagggactgaaagaaataatgtcataaaattgtacttatggttgcaaaatttgaaagcttgtgtattagaagatatttcaaaagatcacagcccatttcttaccctcaaatagacttaacctaaagaattctaatttctcttctacttaaaaagaaaacaaaaaactttccaatttattcaaatgaattatctgaatgtgtaagacacgtgctaggtcctagagagaaacaaggggctgaactgtaaaactggtaataactttcaataaagtttattctcaaaccagctttcagcttaagacaaaaattatttatacatataaagatttcacccatttaaaaaaatctgacttacagtatttttaagcctggcttttagtgtttctgtcaatgtcacattacacaagccagacatttaatatgactggagaaatttatttactgaaattatcaccttactatataccatatttcaagcaaaagttctatataacaacattgaacccgtagaaagaatatatatttaaaacaagtgtattattataagggaagaggaagttgttaattacagtaaagtattaatcacttccacacactacagtcttctcacttagctatctgtattacatttagtgaaagtagaagccttgttacccattccagtttggcatgttctaacacatttataatcagtctcctgcatcacagaaaactcccttaaccagttctttcaggaaagggagtttttctagttagattaactgattctgaacatcacaacaactttattcccttttccaggcactaggaactcaaaacttttaagaatgaacttggtcctgagactaaaactggtctggattatttacctgatctctgaaccagatgccaaacacaagggggaaaagtaatctcttacattaaaaatatttaaagattattaacttcttaacttgaattcttccgactcttctaatcaatttttaattcttctaaattctttccccattcaaacctgggtaaaagtaatcacttagtcaccttcaaattactgtctcttctgtgctcttctcccttgattttcctaatttctttccctcttctaactaaaggttgtagctgtacatactttgctccttctattttatgttaaagctatgacttctaacaatcccaaatttctacttcaaatgctttaaagactatcataaaattgtgacccaattttagttgtactaatttgtgtacctgctaattatcatacattcattaaatgtgagataactaattttgaaaatgtatcttaaaattacaaacattcatatagtagaaactatttccaaataaaagaaatgatcactatttcggatttaataccagggctctgtctcaccacaccacacatttttcttgctcgtttctttaaaaattacaaataaaaaccataaaagcagaattaaaggaaaactactcaaacttactaatttcagtaaacaaaggcagaaaacatttaacactgtagccaccaacactcacaacaggtcttccctttcttattctaagaagatactgtctagatttaaatatattcccatagttgactgatattaatacatttcagtcaaaagtatttgcagtagaattatattcaatactaaataggcttaatgttgctttaacaaaagatttctcagtctcatttcttgaacatgaaacatactattgttaaggtgaggaatatatttttacctaactttggaagggaaaaaattcttcccctattatttaacagtacttttgctttacttagagaactcttgagtctaaaaaaaaggacaggaaatgctggtctggttcaaactctgaaaacatgagcccacttaacattacaatccccataaatgaaaaaaaaaatcctggtaatattctataacttgtatacaactaccgggacaattaaaattcactttattccacattttacagaaagtattcgaatcaagttcatatgtaagtaaaagatctttattgcctttaaaggaaaaaaagtaccacatatttagacaacaggcatttaacacataatcaacaatttgcaaactaataagaaatacaattgtgagttactatttattgggtacttgacatatgccgggcaatgtgctaaatattttacatacaatttcatttaatccttactactatcctataacatagttaattattatcctcattttacagatgaggacacagactcaagaggtaacatgcccaggtcacacagccaagtctgtactgaacctaggactgttttaactacagagatcccctcttaaccaccacaccatcctgccctctccaccgtcgtgcctcctccacatggttatcagctgtaccatgtagctctgcagtattcactcgcttaattataatttaatattctgaataagatacatgaattacattcagaggatgcactgcagtcagaatttatagatataaatgactggtaatactagtaatactaacttataatactataattcatttacttagaaaaagtttcttgagaacacttgagagtaaaccatgtaatgatctatactactttttataattcttacttaattctcacaactctgcagagtcattatcattatgtccatgcaaaaaattaaagaaactgaggtttggagaaattcactcatttggccaatgttataaagtttgtaaatggtagacctagaacttgaacccaggcctgattccaaagaccatgattttctctaaggtattattagcttatttcaggtatgtacaggtagactgataaaataaaaatcagagaaagaggaaggatattagtgcatgtaaaatttagctataaactacccttgctgccaagagaaatatttactaaatgcatagtaaacactaacaactgtgccatgtattcaactgactccttaaaaatattaatatgcttaatattgctttaataaaggatttctcaacctcatctcctgaacatgaaacataccagttttcaccactggggaaacataccatttcaccactgtgaaaatataccatttttcaccaccattttcaccactgttaaggtgaaaaatgtattttaaaatggggtacgccatcttgtaaaattctgcatatttcttttactcaacaaaatgatagacacattttcatgtcagtacatttagatctaagtggttactgaacaaatattaaacactaattattgttgtgacaaaaatagaatgcatggtttctatttactgaatcagacacctttctaagattacacagacatataaacgactagttttgaaacatgtaggtacagatgtgaaggtatacactttcatacatactgcttgtggaaatgtgccaacattttggaaagtaatcagtatgtttaaaaatcttaacaataatccaaatcatcctttggcccagaaagtatcctacatatacaaaagcttcagcccataaggctacaggtattagtgcatttaatgcaccatttttacagcaaaaaactggaaataatcagcaaagaaatgactgaataaagtacatctataatacaaaataatatccatgtagtttagaaaccattttgattgatatgcattaacctggaaatacatccatgattttgttaagtgaaaaaacacatgttgcagagttttatgcaacagcataccccactttcaaacacacacacacacacacacacactcaaccctatattcatataatatggaatacacaccaaattgtgaaaaatacatggacaggagaaacagggaatagagaaattattaacttttctttatatatccctgcactgacttactataatgaattaaaaataaaattttctctaccgataaatatttcaaaagcccttttctattttaatacaggttaaagaatacccaaacaaaaacaaacaaatctcccactcataatattcccaacattatttccgcatttactgataataagaggaatatcttatgaagccaataatacgattgggttcaaaatagaaaaaccaacactcaatagtagagggcatatttttgggagttttttaatagcttaactacttactgtttgctctgattttaaaaactgttatacagctattctactccttagaacctatgatgttactgtataatttttacatagctgatccaagacataacaagggaaaagcaacccattaaatattccaggtaatttaattcttatccttgttatttccactgataagttttttgtttgttttttaacatgcacgacgttttgttaaaaataccagagctgagatggactgcttctgtagttccaacataaacatatctgttaagtatctactaagcacaaagcattgtgccaggctttagcaagacagcaatgatcaaaaaagacaacactgtctctgccttcgtggaactcaacaacagaagcatgctgacttgctttagaggcccactaaaatggaccactactacctgatttgtcagtcaggcggataaaacttctgtagttaatctaataatctaatctaataaaaatgagtggtcaatttcctcaacagtagtacaagtagcccacccacttaaaaaaaaaaccttacttttgacaatatacttaatgtcacttttatataaataatgtgaatcatttttaaaagctggattgcttaatgtggcaaaagtaactttgatggtcttctatatacaggaaataaagtattctaatactggacctctgtttacagaaagaaagcacttaacaaccaaaaagccaaaaaaaacccctgcacttactgctcaagttaaaaggattaatagtgaaaattttactaccgatattgtgtctgagatttgcttcaaaataatttggcaaggaggaggcaagtgtatattgatgaagcaagactgatcactgttgacactggctgataggtatatgaatgctcagtatgctacctgattttgtatatatttaaaattgtctagaataagaagctttttaaaagtcaagtacagtacctctaatacttctatttgtcaaactgttgtctttagccatgcctggcattttttaccacataaaaatgtttcaagcctcttttaaaaaacatgaaacatctctcaatagcccaagttttcacattttatttaccttaatcaagtttcctccactagcacaatatcttactgtgactatgcaaagatatttgatattgataaaaatgaacactccaaattctgttgcaaagttgaagtatgcaacaatgataaagtttaactgtaatacaaaaaaagcaacaactttttaagatgtagctttaatttcaagggattttttaatagctattataatctaaggttttacgtctttacaataactgccatttattgagggcctaacacatgccagctactttataaacagtctctaatcctaaaaactcatttttcagataaggaaaccgaagtgatctacccgtggtcatactactactaaatggagagctagaattaaggcccaggtttaactctacatgtagctctccaaagctatactcctctctcattcattcaaaagatattaaacacccactatgtgcctggcactgttacaggcactgatttactatatgccaagcaatgtgctaagggctttctttaaaccccatttaatcctagcaacaactctaagatgcaggtccaattatcccctttatagataaggacactgagtccgaaaggttaagtaacttgcttaagatcacttaactaggaagtggcagtactggagggagaacccttgacagtatgactccaaaactcttaaccacgacatacctctaggcatgatcaaataaaactgcctaaacagaacttggaagaaaaaatttggaaaggcttgggggaataaaggggtaggagctggattactgcaaggtcaagtttgtcttcaacaatcaaatctaaataaaaggcagttgttcctctacaatatttaccttagaaaaataaaagaattttttaaaggcagttgggatagtaacgaaatgagcagtaaactttgcaagagttcaaatctgggctctgacacttgctgtggggtcaccaggaaggcacctgtcctcttggaacccgtttcttcttcatatatgaaactgaaatcctggcatctctcctttggggtttgtaagcatgaggatttgccagtgtagtggttgactttatggactttaggtcataaaagggtaatcagctgtcatccaatgcgaacacagtaaaaaaggaataaagttgtaactacattataaatggtcatgtctgtaaccctagcctaatttttgaatgtagtacagaaaccaccagccacagtgtgagccgaagccagtttgtaatgtaccatcaacagccagacacacatcacaactttaggcctcagtttcctcacttatgaagtggagacaacttatctccgagggctacgcggggcaagataaataggtacaaaaatacataaatatgtacctggcccacagttaaaacgcttaaaacactccagctctgtcgtcttctcttagattctagaaatgccacaactttctcttatttctagatgctctgtaggttcagggccgtagaggctgtccacgggcctcacaggaacgcaccaaaaccaggacatcgcaagcacaggcgcacagacccagaccccggccccggcccggcccggctgcagggccgggctccccacatcgacaaggacaccggagctgccccgagacgccaagagggctgcgaagagctgcctttgtactcagagccagacgcggcctacgggacgggaccgccacgtctggggcttgcgggctgcagggcggcgcggcacgcgtgggtacaccctgcgggggcgggctgcggccgcggggaacagcggcgagaggggggcccgcgggagatgcggtcctgcccagccgcgccgagaaggcggggaaggcgaggccggaacacacccttccctgcacgcctcggagcgccccgccggttggggagggcaggaggctcaggccggagccgcgcaggggacacctccgcccccgcccaggagtcctgtcaggccggcgccgcggcgctcaccgccgacccacgggctagccacggcctgacggggcctggccccggggcgccgcccgcctgcggcccagtctccaccgtccccacacacgcccctctgaagaacccggcgcgaggaggtatcagccggccggacactacggaaggcccgggttacctggggggttgctggtggctgggcagctttccgggcgggaggggggcgtcaggaccaggaacaggagtgcggacgcagcgggagagggggcgggggcggtcgaccgaggcgccggcaggtacactggcaggccgagaggtgcagacgcgccggcagcagtagcggcagtagcagtggcagcggtgactgctcctgtgctccctcagtatcttcctcgggctggtccaagatggcggcgctccctgcacagggtttcctgtcaccctcgcaatgggccggaccacaaaagaagggggagaagatgcgcgcgcagctggcggagcccggaagagggtggctgaggccagcccgctagccacgccccttcctcagccctcacctctggacttgtcgcgccgccgctgaggcccgccccacgggcgctcgcgcccggagggaaggtggaaagcgcgtatgcgcaagcgcagtcgcgtgtcctcgcctcttgggggagctactgcgcaggtctgcgtggaacctggtggggtgcgcctgcgtcttggagaactagggttgtcgctcgtggagacttttgaacaatttttaaagccaacatttaccacttattggacgcttaccgtatactggccaccatgctaagcatgcatttactgcattcattcaacgtgtatttatgggggcatttactgtatataccgctgtatgcttcgtatataccggtcctgtccaacaaacgtcggaggcacgcatccccattgtatccatggagaaactgaggctcaggttggtcaactctcttgtccaagatcacgcagctaggaagtgaccctgcatttcatctctattttgacttcactttggggttgcctttgacagggtgagagaaatgtgatatttttcacaatttgtctaccacctgccatcttccaacttgctctgccataatcactgccccagaaggtttcgtgcttttcgggtgcagggacacgttttgactttcttggaccctgagcacttttgccttgtggcttgtacattacacacacacatatatttcacacacatgtaagttaaatatatgtataaatatttaacatattttacaactgcattgatataaacatgacgtatcaatattatataacaaaatattttctctgacctgaaagttcatttttttcttctgactttaaaagaatgtaagccggccgggcgcggtggctcacgcctgtaatcccagcactttgggaggccacgacgggcggatcacgaggtcaggagatcgagaccatcttggctaacacggtgaaaccccgtctctactaaaaatacaaaaaaattagccgggcgtggtggcgggcgcctgtagtcccagctactcgggaggctgaggcaagagaacggcgtgaacccgggaggcggagcttgcagtgagccgagatcgcgccactgcgctccagcctgggcaacagagcgagactgtctcaaaaaaaaaaaaaaaaggaacgtaagcaaggagggctggtagtctgcgcctgtaatcctagctactggggaggctgaggagagaggatcgcttgagcccaggagttctgggctgtagtgcactgtgtcactagatagagtgtctgcacttaagttcaggagggagggaccacccaggttgcctaaggagggatgaaccggcccaggtcggagatggagcaggtcaaaactcccgtgctgatcagtaatgggatcatacctgtgaacagccactgcactccagcctgggcaacatggggagaccctgtctctaaaataaataaatattcatttttgttggcccctaaaagtattggaggccctaagccctgtgcatactgtactgtgcctaatggataaggtggccctgccttagttccccacccccaaattaaatcaatctttctcttagcgttcaggaccttttatgaactggttctgccatgaacaagtgagatttcactgtaaaagtgtgtgccagtttgtacatctcatattttcagagacctgggttcgaattcctgctctataatctaatggtatgcagttgtgcatgtcacttgatttctgagattgtcagtcttttctgcaatatgaaaatagtaatatctctctcaaataggtctttgtgaaaattaaatgggatagtatatgcaaaatatctggtatataataagaaatggaaatgattattacatgataatctaatctaaggtgatattgaaatccttttgcaaccctagaggtctaggcttctatttccacattctttaataagtatagtttgttgtcacactttaacatttttgaaactaagaaatttgcctgtgccaagtaaaggagaaaactgtgaaccaatgatcattaattgcccaggtatgaacttagacctggctagtaagtttccttatagccattatcacctgaagggagatctttatgtatagctgatgtttattcaacacttactatgtaccagcaactgtcctaagaatcatgcatattttctcatttaatccttaccacatccgcatgaagtcagtactatatttaccccattttatgaatgaaaaaactgagtgtcatacagatctaaagtcgtttaggtgaaaattgggtgggacttaaatctggcaacatgtgacctcagggctgtactaagccctattccatttcctcccttatttgctcttgtttcacaatagccagcttaaatgcaggtccctaactgctgctttcctatgtgaaagacattacactttgatgcagctttgaacagaaacactcttgtggatgcagagtgcctatcacatgctaaggaatgcaattaaaaaacagtaggaatggtcaattcttttaataagtcccagaattttcaaagtgaggagagtgtatgtgaccagttgcagcataattaagagggactgtccattgggtgccaaacatccattggggtttctacttaacttttttaaaaagttgtttctataagaagagatgtatacatggaatagtcactgcagcactgtttgtaataacaaaaaactagagacaaactaaatgtctatcactagaaagctgtaatagtaaattatagtacatctatattgtgaaatactatgcagccatcaaaaagaatgaggcccatgtatatgtcctgatatggaacaatgtctaggaaatacttggagggaaaaaagcaaggtgcagaaaactaaatagtatgccaacatttgttaaactataagaggagggcaaagaagacatgtatgtttatgtaactagacattgagaggggtttattccatgtatacatctcttcctattgtcctggatctgttgctgaagcccaaacttgaaaataaaaagcccacaaggagctcacattctacactgaaaaaactgccagtggctggggccagctaccttctagcagggaatttgaagagcagttgttgaagaagtcagctcttgaccaacttctacctccactccactactccctcacctattccccatttccaaccccatccccacagacacaccatcaccagtaatctgtggaaagaaagattggagacatgggagggaagtcagcctttagggaaattgtaatgtcatggaaagagacgccttctttctgtcccctcatggagactgtgtcctcatctagaaccaaaggagaggggctccaaaagaatcaccagtgaggattgggtgtgcctgcaggaagatgggactgacaactccctggatatctatctgtttgggcagcactgatctgctctgccctattgcttcctgcacaaaggagaacacagatggagagagacagcactggaggggctttggatggtgtggggagaaccttagatgaagaggggctgaagttgcttccccttatcccttcctcccaccttgactttctagtcccagattggagtacggcaaagaagtgtccatcagagaggagtgtggcataatgacacaagctaaccatctgctggaagatatagcaaatgtgtgaggggtcacctgttcctgggaagatgcctggaatcctccaggtgtgcaggttgtttgtcacctgctctggcttcatttctgcttgtatttttataaattgttttgtaaaaagtagatgttattttatccttcatctcttcccagagcctaaacaattaaagtcattttcagatctctctgttgtgtttatttaaacaaaattaattcatctcctcattataggcttaattttatttgttcattttcctcttatgcttgtgaattttggttcataggcttatcttgaattggagattcccccctacccctatgcttgaatcttttttgtttagtggttttggagttgccaccgagccacactcagactttaaaatactggtgtcccaattcctgaagcagtattgaagatttagaagaactaatacaatttgtactctaaattttattaccacatgtgtgttctacctaatttaaaaaacgaatatattttaatgtagttgattaacttccagtgatacataatttaattaaaaagaaatggtcaaaaaagctagtttaaccaaaaaaagttgagatcaggtgcggtcatggtggtatggctgtcgacattaaccaaaacagaaacagcaattaatatacttcaaaatttagtaggttgacaaagaaatcaaaatcaagggcatgagactcattcgtctctgggtatgaaaaaggattagattcaacttatcacactaaaaaaaggtgatgcataaatgtaacaataagtacattctgtattcaattgtaaaagaaattgtgtgtccattgaaatagtgccctttcatctccccatacaccttataccaccccctcccaaaaaatatcctctcgtgtcacagcttatgagggcatgacattaatgaggtaaaaagcaagcttgaaattttcccaggaaagcaccctaccggagactcatttattgtcattgaagcattcctttggctgacgaccagaagttggtggtttcgacttaagaggccatgttacatgaaaaaaaaaaaagaatgcatctttgaactttgtttgtttgtttgtttgtttcgagactaagtctggctctgtcacccaggctggagtgcagtgatcttggctcactgcaacctccacctcccaggcgcaggccaccctcccacctcagcctgggaccacaggcatgtgccaccatgcttggtaaacatctttcaactttagattcacactcagtggggcataatgaccacaccgtgagatccacatggaaactgagacctactgagaaaacatttaactctttcattgcatgctcactccaaggcatgcacttattcagaaaaagggaagggagattgatatctaaattatttctttattgctttttctgactttgtacatttagttgaaataatgcgagttaaaagcatgtgtgatgtaacacaactgaattaaagtgatgatgaaggtgctgttgagaactgagattttactctacttgcaagctaacaagccagcctgccagtttcatggatacaggcagaagatgtgagacttctgagtcaaagacagaggtctgtattattcacagcacagcaagcagcatgagcatcagcatatgtgcatcagttctctttgtgccaaagacccatgggcagtgatatgaaggggtaccagcacacacagtggattgtattacagaagaaccctgagcttagggaaatcacatattttataatgggaagtaattatatctatttttgctgtagagggaaacactatctctatcctccaagcctgccctacaaacatccttgaaaagacagtctaggacaaagggcagtcagtgcctatgctcacaaaatgtacagaaacatgagacccatggaaggtcatctcccaacaggggcaggattttttgtattgtagaatatagtactgtatttggtggagggagttaatgagtaaatggtatgctatggaggaaagtatatggttttgagactcaaactgacttcagtttcatttcctgtgaccttagacaaatcacttaacttctctcttttttttttttcttcctgtctcacttggtcacacaggctggagtgcaatggcacgatatcagctcactgaagcctccacctcctgggctcaagcactcctcccacctcagccccccaggtagctgagactacaggtacgtaccaccacatctggctaatatgtgtgtgtgtgtgtgtgtgtgtgtgtgtgtgtgtgtattttttgtagagacagagtttcttgatgttgtccagattggtcttgaactcttgagctcaagggatccacccaccttggcctcccaaagtgctgggattacaggcataagccactgtgcctggcccaaatcacttaacttctctgagcctcaactataaaatcagataatagattttcccctcacccatacacacacggaattgttgttcagattaactgggaaagtgtaactgaaagtatgtggtacagtatctagaatattccacgcattcaacaaatgcctggtccttctcttctctcctacctttattcactgattccctcatccatgtgaatcaggcacacacttaggttcctgccagagccctgaaccccttccccagttggaaagcacttcttgagtacctgcttagaatacatgggttcagatgctgcaaacaagagactaaagaatgatagtggctttcacaagatagaaatgtattcttcccgcacatggaagtctgggtaagtagtacagaggtgatatagcagcttgaaggcagcaagatgtaagttcctccttggttatggcactgccacccccaaatcatgcttctatatcatggctcaaaatacttactccagctaacaccaggagaggggagaaaaagaagtagatagcacatgccttcctgttaagtgtatgacccagaagttgtacctattgcttttgctgacatcccattggtaggtcacatggtcacacctagctgaaagggatgcagagaaatttagtctttgttctggggaggattattactaatgagggaagaaaagaatggatactgagaaacaaccagctatttttgccataccatccttcattgcctaaaaggggggcaggtgttagagcaccttgaaggtccagggaggctgatgttaaaccctgaggccaccaaggtgaggacagggaccatcagtggaccatgaaatctttcccaccagtgcagttcccttaggatgcccatttggggctctatgcaggactctgaataaatagcattcctttgcctcgtctgacttctgaacaagttgagatatcaacaaaaagatgcagaggaaggccagaatattttctttattagtgatattgccaggttggagaagaaacttttagggttggtagctgaagggtgccactaatagtgaaccccagaagtgggctgcaaagactagggcaggcctcctgctgaagggagcagggctgaggagcagctccctccctatcagaagaagtgctgagttgggcatgaccaggtattctcaaatgtacaatccttcatccttccaggaatggataaagcacggagaggaaccaagaatgtgctcagaaaaaaatccttcctcactgaaaccaggactaaggaaaggagattcccttctaccatccatggtgagcaaagagtggggcttggaattagcagcggggggtggggaggggggaagaaataccagtggaagcaagcataatagtgcctacaaatacatgagggacccaaactgacaagtcagaaatcatccaacactgtaattggatttcagtcccagccttgcttcttagtagctgtgtggctttggaaagttccttaaggtctctaattcttcatttccttgtctcaaaaatcaggaaacagcagcatttaatacctatgtgaattattaagagaaaatgaagcagagcatgagaagctcttagcatagtgcctggtagggaataaacactcaggaaacagaagctgctagaattatttccaagagccaatacatagctcctgaaagcagtttccccaagtaagttaggaaagaagaaaacctttatctgctatcatagaattcaacagaaatcagaaagttttctttagagtaatacaaataattggagagaagagatgaagaatgagaaacaggcctctctgcatagtatctggaacaatttgggctaggccttcactttctcatattctttgtgccatgaacacacatacacgcacgcatacatgcacaatagaccagtcaagattcatctagaggtgatataataaatccctactctcaggaaaggatattgcctttatagatatattagttaggagaggctaggttttactgtgtaagaaatgactccaaaatctcagcggatttaaaccttatcacaaaggtgtgcttcttgcccactctctatgtccataatgtgtcaactacttccctgttccacaccatcttcactttaggactcaggctgacggagcacgctgcctgtctgtgtctctccgtttctctctctggaacgttgtcagatgtcacggcggagggaaaagagacctggtgagtgacgtgctaagtcttcaagcttctgctccaaagtagcacacatcacttatgctcaaattttcttagccagagcaagtcttatagcctcatattgatagagttggggtgcataattctcctttggggaggtgaatatagctgaatgtaacccagtctaccacagtggactccccaagagccagagagacagccactgagagctgctaatatctggctgatctggggccttctctttgcctcagtttatcctctgtgaaatggagataccagcacccgtcctgtgaaccttacagagaagggctaggaatgcacgtgggatcaccgacatgcatgtggtttggcaactgtaaactaccacacttgcatgagagggtttcaataccagtatgagtgcattggaagggataagaacacattataaaacatttcaccccttctctgcccacaggaatgacttgccgaatttttagcccataaccaggcactgtgtaaaccgctttacctcattcagtctttgcaattataccacaaggtaagtaatgttattaactccactcacagatgtggaaacaactgagtgtccattgaggaatgaatggatgacaaaatgtgatacatgccacatttggggatattgttgataataatgggatgttattcagcctgaaaaaggaaggaaattctgacacatgcgacaacaaggatgaaccattatgctaagtgaatttagcccgtcacaaagagacaaatagtataggattccacttatatgaagtacatagaatagtcaaatacagagacacagaaaattggaaggtggttcccctgggggtagaggaatggggaggtattatttaatgagtacagtttcagtttgggatgatgaaaaagttctgaagatggatagtggtggcggttatacaacaatgtgaatgtacttagtgctattaaatagtacacttaaaagtggctaaaatggtaaattttatattatctatattttaccacataaaaaagcatatgacagcaaaaacaaacaaacaaacaaagctgaaaaaacccacaagtcttaaaatgccttgaaactttgagcaatttggctcacacaacagatcctttagccactatgtaagtaggtgatggcattttagtagctgatactgcttataaatacttccaggtgtaaaagttgctattaataattaattggggatctggctgggataggggtaaggtggataaagcactgaactgggaatgagagcttgaggttaggacttagctgaaaccagcggtgtgaccttggctgggtagcttcccctctctgggcctcaattttcctatctggaatgtagagaggttagttgatcttttcagttcaattttatttttcagaccaaaggaccacagtcttgcagggcagttcaagtagatggggctctatctcctcttccgttctctcccaataaccacctcccc

SEQ ID NO: 86 - DNA, 77873 bp, Homo sapiens
gcatgagaatcacttgagcctggcaggcggaggttgcagtgagctgagatcatgccactgcactctaatttgggcaacagagtgagactgtctcaaaccaaccaacaaacaggaagaaagaaaaaacaggcaacagcagaggacacctagacagatgtcaagagacacagactccaagacagacctctacaggcattataccattgtcctttttttttttttttttttttgagatggagtcctactctgtcacccagctaattttttttgtatttttagtagaggcggggtttcaccatgttggccaggctgctcttgaactactgacctcaggtaatctgcccaccttggcctcccaaagtgctaggatgacaggcatgagccaccgtgcctggccaggcattatacttttaattctacttttgcaagggcctcaagtatcttaaaatacagtgcagcttgagtgcagaggaaagccctgtgctcgaccactccccgtactgctgaggaccagctgttgccagaccagttgtactggagataggcccccagggatttctgtccccactcctaaatcttccaccctgcaggatgccatcttctgtcaggcttctaaataaacggctctttcccttagagaccccggaagacaggcaccatattcagacagccaagaatcaaggtcagggaactctgtagtccaagaggcagagagacacccaagctcatggcacgtggaggccaaaagtgaaagaaactctggtccaacaaccccagaactggaatcgtccagtgagaggtgtgtacaagcttctgcagcaggtgaagcattccaaagggatggaaccacgggaggctgaatgcctatacttaggtcccatctaaagccccgtgactcagaaccagagggtccgagagccagactcacaattgcagaaggccaggtactccccgccagagactgagacacatagaatgagccacacattacagaagtgggaggtggaggggctgagaggaatgatggtccttgcaaaatgtgaaggccagacctctaggaagctcacctggagtcataggagaggctggtggaggcagagccagaggtgctggcagcgtcggtggagtcgacatctgagaagaaggtctggcctgagctggcactgagaggggcaagaccgtgagcctgctggtggcccggcccagcaagttcctgccaacctggcccgcaggttcccctaacatgcatccttcatcccagtggaggcccgtcttcccacagctgagcttcccaccaccacacctgtctgtttcctacccagccacccttcaaagtccaagaagtcaaaaaaacctcctggagcaccctcccctggcggtgacgtaagcactggtgtcaataactcgagcgtgatccaaggcacctgtgcaacacttcacaggtcaaaagtgctttcatttgcattatcttgtttgaggaaaagagctgaggaggttcagagaggttaagggatttaggtaaaactacatagctagtactgataagcagggtctggagttcaggtctgactctaaagccctcctctgtgtcctcaggaaaatactaaatgacctttaataatttggaaaataaaatgatggaagatgcagttcctcccttggacatacttaagcatggggtgctatggaactacaaaggagggcgtccagcacagcctggggagggttagtaaagccttcctggaagaagcagggtcctgagttttcagatgggctagggcaaggcaaagggtatctcaggcagagggagcaatacgagcaaagatgagcaagcatcaaacagcatggtgagtgtggataaccatggggcaaggtggggagggctggagaagaggggagggctgtggtgctctgggaacagggatgttatgctgaaagctctactgcaaaaagccccttcagacagacctgcacagcagggatccttttaactgagggcttggctttctgcttggttccctccctgtctccagagcagacctctgtgctaggtccctcactgatacctttttaaactttgaatttcatccagcgtgaagtcaaatatgctagccaggtggtggttggtgctccaggctgaggtgaagtcactctgtggacacaggaaggagagaggaagggtcagacagcgagtatcaaatccacctcccacacaggctgcctcctatccagccagggccgctgagggctgggccctccctagggtaagaccatcacctttattccaagtcctgaccagggagccaaagtcatcccagttctagccctgcctttgtctctagctgactgtacgaccttcacgtctctggacctcagttacttcaactgcaaaatggggacaataacccctgccttgcttcactcttacagatgtcaggaagtgcagtaaaattaaataatgcttctaaaccgcaaagtgctgggacatgaggcattgctaatactactgcccacagggagggcttcagggaggtggtggggttactgaaggaggaaagaaagtgctctggaaccctggttccaggctgggctctgccactttgatgtgtggcctcaggaaagtcactgccccacccttccctcagtgtccctacctggacagtggggacaagaatattacctgcctttgccccccaactttggattcctgggagaacttggggggagataaagcaggggtcttagagtgcctggcttagctgtaatagggactggcttctttaagggacatgagagagtcctctgggcctgggggacttagttttcggcacaggaagccctaatatgtgctgaccctgcgtatgaaaatggagagtaagaaaacaaggaactaacactgggaatagcatcttccagcaaaaactttgatctttttcttctataaactcgccttttctgctgctggaattcgtgaggcaacaaactgtggagacagaagagggagaaggtggccccgtcagagcctgagggccctagggtggcccagagggaggcgccgcaggggcgggggtcacagcagttggggagacaggctctgaacacagctgcaccttcacagggaggcctggggaggagggagagtcctcaggagcagtaggggtgggaaggtgtggagaaggtatagtgggcagaaaaagaaaaggtgcctccccaggcacatgcatccagatgccctgccccccagtgccaggatgagggggctcagctgagccaggagagagagggacccctcacacaccctgccttccccttcacctccttgcccaagtcctaatccagcaaggctgggtcctcagatctggcttttcctccttgcgaggtaataagggggctgtggtggtgaaaggagttggggatctgggatctgggatcccgctcagccactatctagccctctcagggtcctacagctgggactggctgggtgcaggtcctccttgcttgcttggaagcagagaaaccgagtttggcggcagccctggcccctgggtccccgagcactgacccaggcttgctctttcctctcttacgcagctcagaggaggcgctgttctcatttggcagcagtcctttgtcaggcagcagcttccctggcgggttgggtgggacgcggatgcgcaggcggaagatgcacttcttcttcttgatctccttgccgcagaggaacctgggggtgggcagtgggaggaagaagctctggagtctgtcagtccatcctcctggggagtggggtcaagcatgacacaagcctctctgcctccttggacccagagctaaaatccggatggtctctgcagatgctgacttcctcaaagcccatgggatgcggggttccaggtagcagctgagaacacggctggtgcctcctccctgtgcttcctcctgcatgagtgtggttcttgctgctcttctcccttttgtttgcctcaaccagccccaaggccacctcctgcaggaagccctcctccagcttacagtggaactcctatggtcaagatactggaatctacttcattctgttctctggtttccccaggagactgaaagcaacaccggctgggctcctctgaggctgcagaagtgacttagacacagccctaccctctttagtacaagaggccacctgccctcccaatagaggactgtccattgggagggcaggtggcctcttgtactgaagagcagagctttgtctgggccctaaaccatgagaatgtggaagagagagtggataattctacccagaggtgtctggaagagtttcagcgatgaggaccttattttattccccaccatgacctcagcacccagacaggcccgacatagaacagcaactcaatgaatacttgttgatggaacgaatgagtaaaaaagactgaggcacatcctagacaaagggcagagcatgagtaaaagtgccaggtaggaaaccaaggactcaggatggctggcacccagaatacagaaagcaaagggacagcggcagaggacgcgggcacagcctggtcttaaaaggccttgagtgccaggttcaggaggctgggcatgcctctgtggtgtagtgagggacatggccagctgtgtgtgctgagaaccctggatgggaagacaggggctgagggatgtcttccacccgaggatgtagcccacccgagatgatgcacccatccctcagtgcctggcccccaaggcctagatgtctagagccggaggggccctcagagagcaggggtgcagcccccctacagagctgagcccagtaccaaaatacggcaggctgctggggtggttggagtggctgtgcaaaggaggtggggtaccccctggatctcggagaatggaaatgattcagagagaaggggagtatcagagaggcagggagcatagcctgagcaaaggctatgaggtaggaaggaatctcacctgtagagggccccaccacactccctcccctccctgcacgcaccggcttttataactgttcagagcgttgaggagatgtggtcctcgatctgtcactggggtgctggtgagctgtgggagagcaggccagcaggacatcagacccaggcatatggcgcatggggaggcccaagcccctactccctcccttccatctcctgatgcttctgagtccttcaggtgaggaccactgactcactccaggatctcagaaaagccttttcacctctccaagttcattcccatttgtaaatggagagaatacttcctgacctaactgtattgagagctttaaaaagtccatacccttgacccagtaatgctactccatggaatctatcatggaatctatatatctgcagatataacacgaaataggaacaaaactttacatacaaaaaaaaatggtggcattgtttctaatggtggacaaatgggaaagaaactgcccaacaggaaggaaacaagtaaactatggtagaaaccaatgcagccatgaaatttggcgggcgcctataatcccagctacttgggaggcggaggcaggagaatcacttgaacccagtgggaggaggttgcagtgagctgagaccgcgccactgcactccagcctgggcgacagagggagactccgtctcaaacaaacaaacaaacaaaaaattttatgaagattctaataatatggaaaagtataatgtatactaaaaaaaagattatttaaaattgtatatactgtatcatttaaacgataaaacagaaaaagatatacatagaagagagtcggaaaggaaatgtacccatgcattagttctagtgatttctgggtggcgtgatatggattttttaaaaagtatacttccttatactttttggtactttaaagattttccaccacgaatatgtacaattaaaaaaaattagaaaaaagttactaaaaaccaactctacgtatcttttaaggttttataatatctatttttttaaaaaaattatcaaatactgtaaatgaagatgttattacatgaaatattttgcaaagcataaaggttattctttttaaattccttttcatcaaagaaagatttggggcagtccatagagaagatgcctcactctgtatgtggtggagaggattctaaggatgtcattagggaaaagaagacacagcacccccgtgggagtgattagggaggccctggctccagctctggctcagcctcaaagctctgctgaccacgggcaagtcactctgcaactctgacattccgaaagtctccgtttgtaatttcactccgtggatctgaggcttccaaggcccttggtgacccactatttagcataggatcagcagtgggcagacccactccatgttgcaacctagccaggaaatctggagtgggtcaaacactcagcagagagctgtgttccagccagacttgatctagggcctcagctcccctccactgaactggggaggccccaacctgcccactgccaaaatctgggattaggaaggcccttaaaggacacaagatcagaggcctggactcagggatgcagcaactcaagggtgagagttcagagacttccatcctagtcctgcactgcgtggccctgggcaaacctctctgcctcctgccactgacatcccacaaccccacataccttgccaagctgcaggagctcccagtggtggttgacaaaggccagaatctcctcaaagtcaaagtacttcttcttgctctgtacccccagattatagagggccaggtgaaccacatccaccctgggcaagggggcaaggaggtgggaccaggtgaggtggcagcctgctcagccagggtcacagctttctgggtccaggctgagagacaggggcagggttgggacccagtagctggaaatggaattgttccaggagggaggagggaggggagaagctgggaggagcagcggtggttggactaagccccaccctctcaccatcgcaggggcagcctctcgatgtactctgggccctggttacacacggagcagaagaacaggtaaaacctgtgggtgggtagagacgggggcctatggtgggaggggctctgacacccccaccccagtccagccccttgatctcctcattccccacctaccttcccataatcttctcactcctaggactgctggccactgggggtcaaggacagggcaggacagggactaagagataccccatattccttctaacccatgccctcaatctccttcccaaatcttgccctgaagcgtggctgagttcacagagagtgagctgagctaggctgggctgccatggtcaccctcttcccctctgagacagccacacacgcaatcacaaatgacatgagacaccaaccaaaagatgcataacatcaggtttgacatccataaggactccattagctttgctccgtcggttagaagccacattaagccatccatttccccagtgactcccacagcaaccctgggcagggctggcgcaaggactgtgtcatcccttcttccccagacacttaagagactagggcatagggaaggcaggcatttatctaaggtactccagaaatcaatggcaactagggatgtggcccagcatacttctttattgcctcctggccctgcatagctaggggatcccctaccttgagctgcctccagtaaacaggtaggcatacattgtcacagacctcctcttgtctggagcctggcagtcaacctgcaggagttgttgctgccatccctgccctctccccaccacgcccaaggcccacttggaccaaattagcacctaccggtctccaaacatcatgggctcattgaggcactgggtgcaggcctcgtggaaccactgcctgcaccggtaacattgcagcatccgcaggtaccatctggagagacagaggagccaaggtcagccaggaccacacccccagtcaggtatgagcttcggcaacctttcccaagttaaatttgccctccactggcagaaagggaagagaattcagttactgagcacttaggctgtgccaagggaggacctgagagttggacatatactctcatttcacctcaccacctggtaaaagatgggacactgtccccatattacagataagtcacaggtgaaatggcttgccctagctcacaggcaagtggaggatggtgattcaaattctggtttccctaacttcagaggctgtgctctccttgccatgccacaatgaagccaccatttctggacttgctgcttcccaaacactgctgacagggaaacgtttgccttggagacttcacgggagaataatggtttctgtaagctgcacgggggcaagactacatctggcttttctcacctgcaactgtatctggcctatcatggtcatccaacaactattcatggaatatgaagagcaaaatgctcaatgcttcattgacaccttgtcaggtgagctccaggttaaaacgcagattccttggtccactgcagacctattcaatctttggggaagcctctgggatgcatttttaacaagcatcctgtgcaactctgcccataggcgttgagaaacactgcattaatgcaggaaaggtttccataagcatttctccatctgacaatacttggggaagctcatgggcctgaagttaaggttaagcccatttgagagatgaagtagttcaagctttgcccaagttacccagctggagcttggggctgagattcaggacttcagggggtcctgacggctgaacttcctgagggcagagaccctccctcttacatctgtggttccttccacaatgccacgtgcactcagcccaaagaagcaagctcaactgccatggctacatagaggcccaggtcggcaaggaagaatcaaagactcttgccgcagagccaggacaagaattccctccacagtggccccgacatagcatgccccgccccccggccccctacccctgcctgattgcacatctccagggaaaagaatcttttctatttttggagacagggtcgtcctgctttgtcgcccaggctggagtacagtggcatgatcacagctcactgcagcctccatctcccaagctcaagtgatcctcccacctcagcctcctacgaagctgggactacaggcgtgtgccaccgcgccaggcgggaaaaggatcttcatatctcaccagcagccggttccactgactctgactgtgaaaaggttatcttgactttcatgcattagtaccaccactaccaccagtaacagctcacattttttttgtttaccaaatgccaggcactatgagaacctctatgtgaattacgtaattcatgctctgctcataatcaccacatgatggggaaactattcagagagctgaggctaaggggttgcacagctggtaaggagcagagctaggacgtggacgtcctgggaggattcgcactgtgtccggcccaggctcttaaccactcttcaatacttcctcgtttcctacaaagctccaaggtaacacctctgccctccagccctgctccacagtgctagatgccacgcggagccggccttctgttctccccttgaggtcccgccccctcgggccccaccccgagcccttcccttcagggaccgccccttgaggcctcgcctcctcaggtcctgttcccgaggccttactattccctcctccccaccccgcccctccacagggtgcttctcgacctgcctcacctccctggggccctgcttgggcggtcgcaacccgccaggcccgcctcccgaggcctcgccccaaggtctaaccttccgggcccgccccccgaggccccgccctcaggtccaatcttccgggcccacccctcgaggccccacctccgcagcggctgacccccccctccccgagtcccgcccccgaggccccacccccgcggctgacactccaggcccgcccctcgaggccccgcccccacagcgcaacacactgggcccgccctcaaggtccccgccttggctgacacgccaggctcgctccctatgggcggtccctgctggcgattcttggagacctgccctgccgcccggggggccctgaccccctgccttactctccgggcccgccgcagtagcagtagcattgctgctggttggtgcgatggggcgagtcccactcgagctcctcgggctggtaggacagcaccatcttcacggcctgcagcgtcctggcgatggcgcccttcttcagcgcgccgcctttctggggggagacgagggccccagtcaaccaccaggtccgggtggaccacgcgagtcagcacgcggctgtctattgagggaagtgctgccagggcttgggggacccgcagatattccaatatagtcagaaaagcaaggagctttttctcattaattccaaacccatcccctctatcccagaaggaactccgttgataacagaattaagagtaataagcgcaataaaggcaacaattaccaacatgtatttacatggattttcttttttaatagtaaagcatcatttattggtcccgttattcccgacaccaaacccatctccactttacagttgaggaaactgaggctcagggagtctacaaatcctggccaaggacagtggcagaggcgctatctgtctccaaagcccaggtgtggcccttctgcttggagctcagactctgtgatgggagtctctggtctgccccactggaggaggcaggagaggcagggactggggaggatggaaggctcacccgcacagccagtgcgaagatgcagcgtcggcagaaccaaggtgtgagcaggggctggtcagcactgcccgctatggggatgtggcactgctggtggtaacctacggcagaggagggggcggtgagcgcccacaaggacatcgtggcccaaggccagttggcccaaaggaggcagggctgggagggctgagggaagtcctaggagctctgcctgccagctgccgggagcctggctgctggtgcccaccaagatggccaagtcagtgtccaggctgggaactaaatgacagcattggccagttgtggggttgggggggacacaggaaggtctgacttcagtgcctgagccccatctttcccacccatcctctccatctagctgggccccaaattacatacaccatcataccctcccagctttccccaggatctcttcccaagccctcacttacagcaactggccccctttcaccctgcagtgccaagagaaacaggaagccagctgaggccccaacaggctgcagcagtacccgtcaggggccagtgcgtggggacctataggtcggggccttctcagggccctgctcgctccactcacccaggccacacttcccgcagatgaggatctcattcagcggccctgatgtcttccctaggcagatgttgcacttgggctcctctcctggaacaccggctgaaagagagggcctcgagggtcgggtccagctcacaggaatggaagttttatactcacattccagatgcccagcctctaatgtctgctaggcctagcgctgggccccacatgccacctcactgaatctccccaaccactctgagatgcctatcatcattaccattcgaaagatggggaaattgaggctctgaaaggttaagtcccttgcttagctagtaagtaggtgagggggggattaaacccatggctgtttgacatcaaaccctttgttcttttgacacatcatgctgcctctcccgccttatttaacttgttttgttaaatggttgttattttcttaaaactttattatgggataatataatttgtttgtttgttttgttgagatggagtctctgtcacccaggctggagtgcagtggtgtgatcttgtctcactgcaacctccgcctccctggttcaagcaattctcctgcctcagcctcccgagtagctgagattgcaggtgcatgccaccacacccagctactttttacatttttagtagagacaggcttttgccatgttggccaggatggtctcgaactcctgacctcaagtgatccacctgccttggcctctcaaagttctgggattacacgcgtgagccactgtgcccagcctagaagttataatgaaactccatcttctcatcacttatgaactcatggccaatctcgtttctactatattcccacctacttctccttcctgtaattattttaaattgagtcccagatacccaatagtttttccataaatatttcagtatgtatttgtgaaagatcaagactctttttaaaaaacataattaaaacacctctactgcacctataagttaacataattgcttaatatcattaacaaattcagttaatgttctcatttccaattgtttcttaagtacaaataccttaacaattttaagtctgttcttttgaatcaaagtccccaagtaaagtccatacatggtgactggctgatgtttttaaaattgcttttagtctacaggtcccctctccatctctttttttctttgcattttattttggttgaagaataaatatgtttttatgtgtgaaaggtttgtatgtatacattaaacacattttgatacgtgtttgtcttatttccccagcatgctgaaaattttgtaagggtagaaatgggatctcttcggccgggcgcagtggctcacgcctgtaatcccagcactttgggaggccgaggcgggcggatcacaaggtcacgagttcgagaccagcctgcccaatagggtgacaccccctctctactaaaaatacaaaaattagctaggcgtggtggcacgtggctgtagtcccagctactcaggaggctgaggcagaagaatcacttgaacctgggaggcagaggttgctgtgagccgagatcaagccactgcactccagcctgggtgacagagcaagactctgtctcaaaaaaaaaaaaaaaaaaaaaaaaaaaaaaagaaatggtacctcttcatctctgtatccccaggacctcatagagtgtggcatgtaacaggtgttccaagacgtttgttgaatatatggccaggcaggaacgttgcctcctattcttgaacatgctcccaggaaggtggtgcccacagtgcatctcagtaagtcctcactgggttaatgaagcaatggatcaataactacagtggtgctcagccttatgctctcatctcaggagatgctagagggtcaccattctgcccggaaggggcagttctggctaggagacaagccactcttcagctgatcactgtgggtacctccaaggagcctggtatgtggtgggcctccacaggaggtcagctaaggtgcatggtcttctccatctggctccttatgctttcaataagggggtaaaccaggagaggagatcctcattgctttggatatttatataatactatttcaggggttggagaggaatcggtctgcactggccacaatttcttggagaagggggcaattcgaaagctttactaactggctgagttctgcagcctcttcttggcaggcttcttggaatcatctcttattgtaacaaattctttttttttctttttcttttcttttttttttttttgagacagagtctcgctctgttgcccaggctggagtgcagtggtgtgatctcagctcactgcaacctcctgcctcagcctcccgggtagctgtatttttagtagagacagggttttactgtgttggtcaggccagtctcaaactcctgacgtcaggcgattcacccaccttggcctcccaaagtgctgggattacaggtatgagccactgcgcctggctggtaacaaattcttgagtaacagcttctctaaaaccaatagtactgagctaagcattttacatggattagcttacctaagcctcccaaccaccctatgaagccagtactttcactatcacctctcacatgaagaaactaaaactcaggtcatattacttgctcctgcaaatgcagctagtaagtggcaaagctggaacttggtccaaggtctacctgaccctaaaatctgcttcttaccctgctaggggccatgtctcttctcctgttagagtataaatggcaaacaggtttctcctcttatgccaactctgattgacaggcagtagctgcttggggctccaagttgaaagtacatgtgttgtcaatggctactgatgtctgttgtgtgtatgggaagggagaatggtggcaaagatggccctgacttgccatctctgcaagggagagatgtcagctttctgaaggcagggatgatacccaacccagattcatttcagccctaaaagctggtctagctccatccaggcatgtccatcttcaccctgcctggctcacctctgctttattggtttttctcccattcctcccaactccttgccccgtggagaaggctgcttccattagttttattcatatgttaaatcagggacactgtgcttgcatctagagctgacaattctgaatacctgggcacgcccccttttctagcccagactgacgcagagctttgagcagctgcagctgtagtgcagccaggaagcaaacgcaggcctgaggcccagtcctggccctcccagcacctccctaagctaccttccccacctgcccatcctccctcctggggtatgaattctcaaggggatgactcatgtcctaagtaccttcctaagtcaatatacaaccagatttgatcatcatcacaggtgggcttggggttcatggtcaagggcagatgccaggagtaagagatggaaggacagaaggaagaaatgaaggcagcagaggagagaagacctggggaggttgggggctacccgaaatgttaggaaaactcaccatgctgtatgtccttccataggacccagtatttggaattatcttcgaaagtcacgaggcagctttgcttagagctgctgacctggggtacagataggaaggagcaagtgagaaagggctggggaaaagccaacctggaacatagtcttcctcccccatttttgtctccgtatgttccagaaagcagggctagaaggggaagaaggatggcagttcctggacagggtgtactcctagtcacctggagtcgtacagccagggaccgatggatggcaacttggtcagaatgttgaggacagaagcacaagtcagatgctcctctgtgatcctctcaaacctgacttttttgttttgtaggctctcagagcacttttctaaagaactagttggatgatgttgaccctagggatggtgcctgcaagaccaggctctggcccctcccaccaccagctttgggcatgagggacaagaagggaattctccagcaatccccctgccccctggtctgacagccaggctggaacatgagcagagagattctgagtctgagaacaggggccagagaggatgggtttaccctcttgatcttcccgaggtagtacaggccatctgtccaccggcacagcacatactggccctccgtcagtttggacatcaagtctttgaagttgttcttgaccttcgccagggcccccttgttggggaggtggctggtggcaccataggagtcccgagtccctggatccagagctcgattctccatcagcttcccctgacactgggagagaaagaacagggtttttgcttcttgcttccctgcttcagaaagcccatcaggggaaggaaggaaaccaccatttctgtaccctgtgctataagccagacttggttattatctcactgattcctcgtgaccatcctatgagggagacattattattattcacatcttacagatagggaaacaggtgtggcaaggagaagaggctgatgggccaaaggcagagccatggcccataccacactaccttttaaagagaatggatctctcaacccacacagaacaaagtcccctacccagcgggcctgaaccactccctgtctcaggaggctgaggttttattccttaagcaaacacagtccatgtgctctggatggaggatcttctccaggcaagcagttgggttttgtttttacccccaacccctgcaaccatccctaacctgagatctgtccagagaaaattcacctagaaaggaaaactgggtggcttgtagctagtgtagactgggtcatctgtcttttgtaatccccccttctgttctcaattatgagatgatttaatggaaaccaattctgggacatttaaacccacttatgctttcacccagatacacatttgctccaagcagtgaagtcatccatccccatgccagcctctccacgcctgtctctcaccatcctattcaacgtgcagttcacccatcgatttctctctccctgcctgtggtactgccttcatgcatctcaaactcctccaagcaattagttgccacagccggcccattttaagtgccatgatttctggctttccagctctagcttccatcctcctgccctggtctcagttcaggcctcatcttttgcttgggccattcattcattcattcattcacccaataacagtttcctgggccttgtgcttacctccactaggcacctagggtggggaacggtactaccagcacccagtgctaaacaggccgttcctgcattcctgcctctccaccagactcttccgcagggccaccaatttccttccagaaactttctggggctccccactgccctcactggtgctcaaagccgtccctaacgccccctcctttctgctgggctcacctggctccaagtccctccacatgctctccactacagccacacacagcctctctctttccccgcgggcctactcgggtctcctccttgtggccatggcgctgggcacctggtgttgtgactatctgttcacagggagagagtccagtgcctgtttctgtgtggtgcgtgtgtgtactcctgtgagactgggcaggatgatgtctacggcattgtgccagggagtgtgtgaagctaagtatgtgcggggccctggggcgagccaggcactgcaggggtctcggctccccagatggtggcgtggccacgaccttctccacccccactcccatctcctttttctccagcgcagagcgcacaggctcccgggcaggggatgcggtctgaatccctgtcctctccctgccacctggctcgcccggcgctgcgaggtccccgcccgcccggccaggggccaggccggggccgctgcaggttcacaaactgacacttcctctcccgctgcgcctctaggagccggccgggtcgccgcacccgcctccaccctggccgggcgggggcccccgggtggcgcccccccagcccccgcctccgtcctcccggagcgggcccccgcgggctgtgattggctgattcaaacccatttgcaaagaaatgcctgtttgcgggttcccgtctgcgtccagttcaaatccgcggcaccgggagcgcggggccgggcgggggcaggaagcgaggatgattcatgcgccggggcctctcccagggcggccgttggctttttaaaaaggatgttcaggaggggggaaaaagcttgcagaagcacccccttcgggttcagcgctcctctcctcagtcgctcggacgccaagcctcccccatcccaaccctgccgcagcctgacttcggacgtgagcgaaatgccaaacgcccgtctgtccttcccccaccccgataggaaaattaaagatcgggggcgaggaagaacgacctgtcacccatgccccccggggctcgggaacccgggtggggcccctctgccccgcaggtaacctgcacccccggtccccacccccgagagccccgctccgcaggagtctcaccccccggaggcgttcgggccgccaaagttcagggagatttcgaaaagagagggatgagggccgggaggggagagcgtggcggggagtccgcccaacagcgcagaactcaccgcgaggctgcgtgtccgccggtcccacttggagtctggccaccaggcgcatcggtggcggaggcggctgcgctcggcccgcggctgcccggccgagtgtccgcccgtggggccggggtcggggtctcggcgggggcggggcggggcgggggcgccgcggggaggagggggaggcggcggagggaggggccggggcgctcaggaaggggccccccgggcgcggggcgccatctttttcgcgttttcccgcgaattattgacgtcccgcttatgtaattagcgggggccgcgccggcctcgccattggagcccgcggccgccgggctccgcagcgccgccagcccccgcccgcccccgcccgccccgcgggcgcgcatcctccgcggccactagccaggacccgggccccccgccgaggagcggccacaccgcggcgcacacggagacgccaggcagcgctcatggcgcacacgaccgctcgcacacttgttgaggaaacacagctctgcgcgcaggcaccggcggaccctggcacagacacacagcagggcggcgcggacccttggcgcagacacagacccaggacgcccaaacaggccacacaacaccttgcactaacagcacaggcgttcggcacagagacacagcacaagtataatgtagatacacaacacacagtgcacaacgcatgttgttccgacacaggtcagaacacaccacagcatgtacaggacacaaacacaccacaaagagaagtactgtacacaccagccataggcatagatacacaagggggaacacactgtacacaacagagacacacaacagaacatgcatgtaaggtagacggacataacacataaagtcacaacacagacgggcaagagacacaagttttcctgaaaaagtggcattcagataggttgtggaaataggttagtgggtgtgccaggtggagggaattcagtgggctaacaatgcaatttttaaaatacgggttaaggatatcaaaaggcaattcacaaaagaggaaacctacatggccgaaatagccccaaacaacaaattgcgtagagacacagtgcacagaaatacatggtacaatcgcaaatatataccacacgcacaacatgtcatgtaaataaagggcacacaatgaaagacaacatgcacagagtcataggaatggcagatggagtcagtgggcagagctccaatcatagggaccctgccctgtgggggaaaggcagacatggccccacccagactcactcttgggggaagggaggaagaacacttaccaataaccccacccccatccttgccctcagtccacagcgcccacctctgtggctaccatcccactctgcagacacccccaccagacagggatatgtgctttcatgggtgtggccagtggacagcaccttcccccagagccttccctgttcactgtcagttgctcactctgggccctctgcctcctggccttggagcatgatctgtgcagccccccacctcaccttctcagcagagatccaggagtcctttcacctccttcctcacttccttctgccccttgatccccctgctctcacctgcctcactgccccattctggatcctggcgcctcagcagaacctagcactgctgagtacctgcctgaacctggaaggaaagcctgggagcagccccatggcacaaaatctcccaatcctggagagcacattttcaagtcccaaaggggccctaggattgtgctacttaaccatgttctgccaagagaaggtgtgtccaacgcgggtagggctgatgatgggagcagaacactcccactagcttctaagctggctgggtctgccttcaggatgctgggggacagagatgatagagcgaagtgctcacctctgaggctacaggccagctccacccattactggccatgggagcctgagtgtgtcacttctttctttcttttttttttaaacaattcttgctccagagactttaagtcttaagcctccgtgtcctcacctaaatagagttattgggaaggttagagttaatgtatgcaaagcccctggtgcccagtaggtgtgcagtaagtgatcattgtattaatactttgttaagaaattctgtattcagaatcttgattgccccactgtgtgggactagagcggggggatgtgagacacacaggtggatgggagacacacaggtggatgagagacaaggaactggcaacctcgtggaggaggcggtgttgatgcatagataaataagaggggattgtgctgtgagctgcacgtggaattgaattgtcctggcttcaagtccagctctgcctctgagccagggcggggtcttgggttagctagaccctcctacaccatgtttctttatcggttgaaaagagggtaataatactacccatctcgtggggctgttgcataaatgttcaaataagacaatgaaggagcaggtgcttttgtaaactaaaaagtttgatatgcaaaataagaagttaaaacactacagaacaggaaattataaatgccacaagaaaggtacggtgtcaccagtgattatttagaggcaactctaaattcgaattgaggaaagagaacaagtttcccggaaaaagtagcaatcagttaggttgtggaaatagggaggtgggtgtgccaggtggagggagtttaatgggctgaccaacaatccaattttttaaatatggattaaggatatcaacaggcaactcacaaaagaggaaacctaaatggctaaaatagcctaaaatgtgaaaaggtgctcaaccttattggccacgtgagagacgcaaatgaagagaactgtgatacaccattacacatccaccagatgggcacggagtcgagtctgtcaatataggggggtggggggtgaggatgtcgcacagttgggaccctcaaatacctatggagatatgaactggtaaaacgattttggagaacagtttggcaacttgtaagaaagtggaagatactcatagctacaattcaatgactccactcgtcattcagcgcataattgtgaaaatttagaaattaatgaattatccatgaacagcagtccagataggccaggcactgtggctcatgcctgtaatcccagcactttgggaggccaaggcaggtggatcacttgaggtcaggagtttgagaccagcctgatcaatatggtgaaatcccgtctctactaaaaatacaaaaattagccgggcatggtggcgtgtgcctgtagtcccagctacttgggaggctgagacaggagaattgtttgaacctgggaggtggaggttgcattgagcgaaatcgtgccactgcactccagcctgagtgactgagcgagactccgtctcaacaaacaaacagcagaccagatagattaattgtgatgtagtcatacaatggaataatatactgggagtaaaaataaactaagtctgcagcctcaacatagttacaccctaggaaaaaaactaacatcaagttgtagcataggtacagtgtgacacaaatgataaaaaatgtttcttaacgcattcagctgggcccgtggctcaagtctgtattccagcgctttgggaggctatggtgggaagatcgcttgagcccaggagttcaagaccagcctgggcaacatggcgaaaccctatctctactaaaaatacaaaaattagctgggcatgatggcatgcacctgtagtcccagctacttgggagactgaggtgggaagattgattgagcccaggagtttgaggccacagtaagccatgattgtgccactgcactccagcctgggtgacagagagagactttctcaaaaacaaacaaacaaacaacaaaaaacccaaagaaatacaaaataagctatgtagacattttggggctacagtcagctagtaaaagtattgaaacatgcatgggaaatcaaagaccctagatttagaatagggtaacctttgggaagggagggacaggaatgagatcagaaggaagcacatcgggggtttgttttttttttttttttttgagagagtctcgctctgttgcccaggctggagtgcagtggcgcgatctcggctcactgcaacctccgcctcccgggttcacgcccttctcctgcctcagcctcccgagtagctgggactacaggcacccaccaccacgccccgctgattttttatatttttagtagagacgggctttcaccgtgttagccaagatggtcttgatctcctgacctcgtgatccgcccacttctgcctcccaaagtgctgggattacaggcgtgagtcaccgtgcctggcccacagggggtttaattctatctgtatgttttatttcttagaaaaaaaaattaaaatctgaggcaagtatgaccaagtgtcaagatgtaacagagctgggtggttgatccatagttgttctctctgatccttctccttctcaagtctaaaacttttccatgtttgagatatttggtgattttaaaggtgggaggggcaggaagctatgaggagattgcagcagaggaggttttgatgatagcattgcttgttaggtgtccagggtggttacagtgcacagtgtcccctcatgcatgggactgatcacccttcttatttgtttgtttgtttatttgagatgaagtcttgctctgttgcctaggccagagtgcagtggcacgatctcggctcactgcaaactctgcctcccaggttcaagcaattctcctgcctcagcctcctgggtagccggggttccaggtgcacgctatcacgcctggctaatttttgtatttttagtagagattgggtttcaccatgttggtcaggctggtcttgaactcctgacttcatgatccaccagccttggccttccaaagtgttgggattacaggtgcgtgccactgcacctggcccacccttctcttttaaggcttgtcacagcgtggtgagccaggtgtggcaggcatcaggtccattttgcaggggatgaaatggaggtttggaaaggcgtagtgataaactcagtgtcacacacaatagagagtcagggcttgtcccctctgctcagcagtgtctcagtacctctctgtccagggagaccaccaaagggccagagagccctgagagaaggttccctgcctcccagtgatccatcctcttccttctgctgtgctattctatgttttctttcaattaaggacaatttggaaaatgtcaaaaagcacgaggaagaaaataaaagtaacttgtgattttcactgttacttttaaaatcagatttatcgaaatatacttcacgtatgacaaattcacttacttaaaatatacagtcattattttgagagaacatcattttctttcagaaatacttatttgaataccaaacaagttagcctatatgaaagtgctctacagccaggcacagtggctcatgcctgtaatcccagcactttgagaggctgaggtgggcggatcacctgaggtccggagttcaagaccagcctggccaacatgatgaaaccccatctttactaaaaatacaaaaattagtcgtgcatggtggcggccacctgtaatcccagctacttgggaggctgaggcaggagaatctcttgagcccagaaggcgtaggttgcagtgagccgatattgtgccattgcactccagcctgggtgacaagagcaaaactccatctcaaaaaaaaaaaaaaaaagaaagaaactgctctacacacaagaggcttttcacaaatatgaataattattattacataatttttggaagtaattattatgcaggtgaccagttagacgagcccatgttttatggcctgaatttcggggttggtttatcatgtcctcagcatggaggtgtagagagttttcagattacagtagaaagcacggttattaacaccagttttaaaaaaaatggttgccagggtcagactgtgacctgttggcatgcctgtggccttggttagctgccaaactataaacacctttacctgtggcttttgtggggaaatgagagaagtctgcctgccttctctgtgaacccagggggtgtagaaaagaaaggggagccttcaccagacactggagatcctatttccctgccttgccagcttgctgtggaaccaaggatcccttcccttgtctaaattttagtctccccatctgttaaagataaagtggtggtttgttcaccctttcaacatagtgcacatgtgtagcgaaccatgctgtaggcaggcaccatgctaggaatgacaggcgtggcatgaagatgaataagatgcagcctttgatctcaggaagctcccggtccagccgggcacggtggctcatgcctgaaatcccagcactttgggaggctgaggtgggtgaattgcctgagctccggagttcgagcccagcctgggcaacttggtgaaatcccatctctaccaaaaatacaaagaattagctgggcatggtggcatgcacctgtggtcctagctacttgggagcctgaggtgggaggatcacttgagcctggaggcagaggttgcagtgagctgagatcacaccgtgcactccagcagcctgggtgacagaacaagacactgtctccaaaaaaaaaaaaaaaaaaaatagaagctcctggtccagagctagggggtggggctagggggacagacagattgatagataattgtgggagggtgtcgagacaaggagtgatcaggacaaggagggtcagaccacaatgacctctaagttgcctctgatggcaaaattatttgattctatgaactcagtctaagctttgtttctccctcactcggtaacctaggatgggtcacttctctaatcagggcttcagatggactcactggtcaatatatgaagtctagaacaaatgagttgctcccagtcattctttataaaggttgttatataaagatttgacccaccaaaagctgcattgactatttgcgagatattttgtcttcttgttttttatcaattaggtctacatactacattcaattagagattttgattgatatgattaaaacagtgtgatcataaaagactgactcagatatagttaattaaagatacctttaaagttttccccacgttaaaatacagaggtgtcattttattaatgaactccagtatttacaaggcatcctttctggaatcaagcaatccatgagtcgatccgcgtgaggtggatgagctcctggccccaagctgggtgtgtaggagaaagaggaaatgtatgagatgagagctgctccccgggagccaaggctcttgctgggcatttcatgaaggagacaagatataaccaactgcccaagatatagccagaggagagcaaataagaagatagtggatacaacagggtcatttgtatgattcaactagtattggtggaactgaggtttgaacccaggtgatatggtgtattcaaaagctaatgccagtctgggcacggtggctcacacctgtaatgccagcactttgggaggctgaggtgggcggatcaccagaggccaggagtttgagaccagcctggccaacatggtgaaaccagatctctaccaaaaaatacaaaaaaaaaaaaaaaaattagctggatgtggtggtacacgcctatgatcccagctactccagaggccgaggcatgagaatcacttcaaccctggaggcagaagttgcagtgagttcagatagcaccactgcactctggcctaggagcgagactctgtctaaaaaaataaaaataaaaattaaaaaaagccaataccagccactcatgtaaatcccaactacttaggaggttgaggtgggagaatcatttgaggccaggagttcaagaccagcctgggcaacatagcaagaccacatctctaaaaataaaaataaattagctggggtggtgacatgcacctgcagcgccaactactcaggaggctgaagtaggaggattgcttgaacccagaagttcgaggatgcagtaagctatgattacatcactgcactccagtctgagcaacagagtgagaccctgtgtcttaatggagggaaccttccaagtcaagttttccaacttctcattttcagatggggaaacggatatctagaaagcaggagaggttcggcgcagtggttcacgcctgtaatcctagcactttgggaggccgaggcgggcagatcatgaggtcaaaagtttgagaccagcctggccaacatggtgaaacctcgtctctactaaaagtacaaaaatgagctgggcatggtgatgtgcgcctgtaatcccagctactgggaatgctgaggcaggagaatggcttgaacccaggaggcggaggttgcagtgagccgatatcatgccactgcactccagcctgggtgacagagcaagactctatcttggaaaaaaaaaaaaaaaaacaaagcaggagaggtctggccaaagtcctgcaggaaagacgcattcaagatgaagtagtaaatcagcacatgagccataagtgggtccaggcctctgcccctcccttgcccagagatgtatgccatgccacttttgtcaggtccccagcagtcctcttgagttttttaattgccaaaatttattttaaaatccttctgtttgagtgttccatgacatgtgaccttcttatgagtttcagaggtaatccctgcctgggtggaggaatacctaagtgaccttcaggacctctttcagcttggagaagcggaaattctgttgccagaattccatggctctttaaagctaatcttcactcttttacagctctcagaaggaactctcacgtctggcctttctctgttgtctgttctgctccctgatcttcggcttaagttggggcaatagttccaagaggtttagctgggaccattcagatctgtgtcttatagctgcttcttccaagattacaattcaaagtcccagatgcctccccctgcagaggagaggaaacatctgggctggagctgcacggagagagcccagctgtgtgggacatccctcagggtaggagcctgtgagctgagagctcttcattgcagatgtggttctaaccatcggggtctgggtctcacccatgaggcttcgacaggccccaggcatgtgtgtgcagggaatctgaacagtcagcctgcaggaaagaggctctggggagttatatgtggctggtgtggtggcaagtagagtttgtatggacaccgaaccaaaatagagaaatgcgaaggcagctagacagaaagtgggtggggggaagcattccaaggaacagacctctgcagcaaggagcttggtctgtgcaggtcacagggaaagcaaagaaaaacataggctcaaaccacgagtcatttattcactcatccttcacggctaaccacagcatttagccatgcactcctggtgtgactatggagatcccttccacagccagatgacccaatgtcagctggagtgtttcccactccaacggctggttcatccagcctgtagtcaccgccctctggcagaggcaccactctgggctgacccctctgtgatggtcaattttatatgtccacatgactaagctatcatacctagttatttaatccaacatcaatctaggtgtcgctgtcaaggcatcttagagatgtggttaacatttatcatcagttgactttaagaaaaattccctcgagaccagcctggccagtatggtgaaaccctgtctctactaaaaatacaaaaaaattagccgggtgtgattgcacacacctatacagctacccgggaggctgaggcaggagaattgcttgaacctgggagatggaggttgcaatgaggcgagatcgccccactgcactccagcctaggtgacagagccagactctgtctaaaaaaaaaaaaagaaaagaaaagaaaagaaaaaagaaaattaccctcgatagagtgagtaggccacagccaatcagtggaaggccttaagagtaaaaacaggtttctggctgggtgcggtggctcacatctataatcccagctctttgggaggccaaggtgggcggatcacctgaggtcaggatttcaagaccagcctggccaacatggtgaaatcctgtctctactaaaaatgcaaaattagccagtcgtggtggcgcgtgcctgtaatcccagctacttgcgaggctgaggcaggagaatcgcttgaacctgggaggcggaggttgcagtgagccgagatcacgccattgcactccagcctgggcaacagagtgaaactccatctcaaaaacaaaaacaaaaactgaggtttcctggagaaaagattctgtctgaagactcaagcatcaattcctgctgagtcgccagcctgctggcctgccctatagattttggacttgccagctcccacaatcatgcaaattaatttcttaaatacatctgtttatgaacaaacacacacacacacacacacacacacacacagacacacacacacacacacacacagatggtccctgaatgatgatggtatgccttatgattttttggctttacgatggtgcaaaagctatatgcattcagtagaaatcatactatgatatttggtaggttaggtatattaaatgcatcttccacttacggtattggagaagccccatcgtaagtggacaagcatctgtatacatacctagtgtatctcccattggttctgcttctccagggactgaccgacccaccttccttcacagtccttgagaacggagctcgtcccctgagcacctaatgacacgcgtgcacgtctcttgattccttgtcctcttgcaagtccccacacgtctgtcgcccagactggagtgcagtcgcacgatctcagctcactgcaacctctgcctcccaggttcaagcgattctcctgcctcagcctcccaagtagctgggactacaggcatgcgccaccactcctggataatttttgtatttttttagtagagaggggggtttcaccatgttggtcaggctggtcttgaactcctgacctcaaatgatctgcccatctcggcctcccaaagtgctgggattacaggtttgagccaccgcgcctggcccagcctccttcttcacactcatgacccttaaaaggctagaagctcccagatgggaatggaattgcagggagaacaagcttggtggcagctcgaagagctgagaggtgtggaacccagcactgagccgtgaacttatgtctgcctttcaggatgcaggcagcaacctggacaactgggtctatctgctgtgataattctcaggccttggcaagagaggctatgccaatattttcatggcacccaaaaatggttttcctgggaagaaactccttggtcagtgtccacagcaccaggggaggtggctatttcctgccatctctgtaaacaggatggagaccaagggccttgtatcagttggaattcttgattatgagcaaccaggaccaactctgtccatccaaagcaaaagggggactttctggagggtactgaaggtacacagaatgaacaagaggctggagaacaggcttggacaaagggcaggaccaagagaggaattctggccaagggaaggctgcaggcacagtctgatccagggttctctactgtgggtgagtgatctccaagggtcccctcaccactcactcaagagtcagccccaagaatgattatctgattggctagtgttgcattttccatgtgcctgtccactagccaggcaggataagatgccatggaaggatttagctccactaggatttcacagtgatggtggccttgggaggtgggtgctagttttatccttcctcaaaatggggagctcctccaaaaaggaaccagaattttaaggtgggggtggatgctggacagatcataagtgacagctaaacctcttggagctattgcccaccttaggccaataacagatgaggccaggcgcgatggcacacgcttgtaatcccagcactttaggaggctgaggcgggcggatcacgaggtcaggagtttgagaccagccttgccaacatggtgaaatctcgtctccattaaaaatacaaaaattagctgggcatggtggcaggcgcctgtagtccctgctactcgggaagctgaggcagaagaatcacttgaacctgggaggcggaggttgcagtgagctgagatcatgccattgtactctggcctgggcgacagagcaagtctccatctcaaaaaaaaaaaaaaaaaaggaccaaggtagcctgggcgcagtgactcatgcctgtaattccagcacaggaattgggaagccgaggtaggaagatcctttgagcctgggagttcaaggccagcctgggccacatggcgaaaccctgcctctacgaaaaattaaaaaattagcctggtgtggtggcaggcgcctgtagtcccagctactcaggaggctgagttgggaggatcaattgagcctgggaggttgaggctgccttcagtgagccatgattgtgccactgcactctggcctgggtgacagagcaagaccctgtcttgaaaaaaagaaagagagagagagagaaagaaagaaaagagaaagaagaaaggaagaaagaaagaaagagaaagaaaaaagagaaaaagaaaaagaaagaactaacaagaaagaaagagaggaaggaaggaaagagtggacaggctctaggatctggactggacttggacttagaatctggacttggacaacctaaggtcaggttctgccatgtattaagcaatgtggataataatggcacccacagctcacaaaattgcatgtgaaaacactttgtaaactataaagtattttgagccctggagggcagtgggatgggaccatcatgcctcaggcagcttctcatctcagtgcccagttcaagacctggcacccagtaaatgtcccataagtgtttgctgagtgaatagataaacaagtgattatcatcatccttttaacttgatctcagctttgcagaataaaaacaggcagatgctgttggaccctgattcaggttttgtgagctgaggcctcacaaatgagcctgcttttttttttttttttttttttcctgttaacgcttttgacgttttcattttaatatgtgaaacctggctacttgtctcagggagagtttatggaaaaaaagcttccagctggctttgggcagcccataaaaatgtactgaaatgtctaactttgaccagttagaaattaggagctgttgggggatgcaggccggtgacgccactcgccctggtgaggccactgaatttcagtaattagctctctgggcaggaggactcgctcctaattccttcctggttccgagtcaaaggatgaggccctgaatctgttaaagagaaaccacagctttcagataacagacaaacatgtctttaacacacgcaatctttgattcaaatgatttcaaagggcatgggggagggaagggtttttgtgagctttaaccgaagccgctcatcagaatgtcagctctccaaatcctatccttccctcagctcaagtctgacctcctccaggaagccctccttggtaaccccagcccatcacaggtttgttcatccacacgactccttgctttaaaactctccagagggtctgcctaacttcatggtcaagttcagtcttcttagtttggcatacaaggccctttgtgatctgacaccttctcacctgtgtagcctcttctcctactctccacccccaccctttaacccaggtgcgacaaacaaccttcacccctctccccggaatttgggcctcagagccttggactgtgtttttgccttgatggggattttccttccccttcgtcatgtggctggatggtccttattcccaaaactcaccccaagcctctcctgcaggggtggggagagattgagcccccagggctgggttaggtatccctgctcatgccccagagcgcctgggtttctgctcatcacagttagtgtaaggatccatttactcatctgcctctcccgccctcttcccttctctcccctcctctcccctcctttccccttcttctcctctccttccctcccctcccctctctgaggaacttggtccagctacagtcaatatctagagaaggtattggcctagagaaccttgctcaatcttaagcccgcacacctgccgtactttgggatcaccccgggaaccttaacatgctgatgcctgtgttcttatcttcagagactctggtttgattggcctggatgtggcctaggcatggggtgaagagtgtgggttgaaaagctccccgggtggttcaaggtgcagcccaggtggagcgccaccataatttacagcacacgactcaagacccacccagccacttagaggagctgcactccaggcacctcggggagtataaccttgaactcggaaccccactatatttgccatatttgttgtgttgaaagaaaactagtcatctgtttatctgagtcagtagcattgagcagctgtatagtcccccacaggccccacccagtcttccgtgcttgttaggagagacggaagcatcacagtcacctggtagaaggatgcctgtctgagccccaccccaaatccaaggagccagaccagggaccctgtgctataaacaagtctcctggtgatccttctgcacacaaatgtgccagggctcaaaacatcctaaaacaggctgcaaacccctgacgccttgcagagccaggtaggaaagttcaaagcaaagaaaggcctccaggggaccatgcggggactggaaaacgactggctctagcaaattcttgtcctttgggaatgtgggccccatgttgtcaagtccctcttttttaaaaagagaatgccaaaaatctgaatttttaaaaaggtgaaacttgtttaaagctgacaactaattcaagccatttaagtacacagctcagaccaaacaaaacttacctgggacctgaatttagcatctattaccaatgtttgcggcaaaccccacacgtggatgaagctagagggtggtgtgcttgcctggccttgtctcggctctctcttttttgagctgttttcctgctatgggacttgggccagcacggagtaggagtggggaggcggtggggagcgggtacaggaaacggcccctgagacttgtgccgtacgtgcaattgggaggctgtttggggacattgttcctcacgtttaacagtgttctcttcatgccaactctctaaaaaaatacctctcaggtctcagggcctaatagagttttgatttgcctcagcaatggtgtgccagtgtcttatggacactgaattgcgtgggatcaagttttagctgctagaaaggtcagagggcaatttgtggcctgtccccatggcatataggacctcaaggtccacacttgtatacctgtcattcctgggtgcttctgacctttccaacttctgtttttcgtttgatgcttgtcacatgaccactcctgtaaaattttatgcttgtatatcaaataaagaagttaagtgctttctgaaataaggcatgctataaataaataagcccataaaaatagtaagtgctgaaaaaaagggttattgaatacatgactacttgaatgattcattttgtggttgcacacagggccttgcacagagcaggtgttcaggaaatgagggcaggatggtagagtggaaagcagcagtttagagatggaaagacaatagccctgccatttcctagcgactgggaccttagccaagctgactaacctctcttagcctcagtttcctcgtctgtacaatggggacaatctcagtgccaccttatcagagttgctgggaggattgagtaagatgatgtaaagtgcctagcatgtaacaggcacttaataagtggcagctgtgattatttcaacaccagaaataccctcatctatgaatgtcattgttaaatgacttagtaaaggcagtaatgtgtgcaacatgagtgaggacgctctccctttgctcaagccagctagagtgtgacagagaaaccacatggattcactgggtcaataaaatggggaggccttccagaagctctcgattccctcagctccttgtcccaggtctctgctcccctccacaccagggcccctctgattatagcagtgatggcaggtggctccctgtctgagtgtggctgccccatcactcccctctcagcatgcttatgtgctaaagaccctgtcctgtctgcccccgtcatccaatctctagccctagccctgtacattccctttctggaagcctctggcagttttctgcaagcttcccagccctgactgatccctctcctggtcatcacttaagtgagcaaattcatctttgaacggttccttgaccttttgcttgacagatgcacgcatgctttagaaagcacacgtcatgcagtgcacaggaggtgcactcagagatgactgaatgtagtgtctggggctcactccctctgagggttggacaccaggcagacagtcaggaaagcaactctctaatactgttacgagggagaaaatacatcatatagatccctgcgatggaaggtggtctatggtgagttgtaggtttccctaagggcctaaaatttattcataagaggcactgttgcatagggcagtggttctcaaagtgtagctccagacctggagcatcagcctagactgggagctcttataaatgcaaaatctccagcctcactccagaactactgactcaaaccatgtggggcccacccagcgctcccagttttcacaagcccaggggtgatcccatgtagggccggtttttggaccactggaatggtggattcatttggaacctgtcacctcatctgtcaacagggacgaccctaatcatggcagtggcttctggaagggccacgagatgaacgtgggaagcctgcctggcacgtggttggtgctgagccaccgtcccctaagactgatcacccactacctttggagggtcagctaccgcctggcgctgttctctgtcagtcatggaacccaagataagggctccagcagaaaggagaaacaggatggaggtcagggaaagctgatctgaaacttaggctaaggccctgaatgccaaccttaggacctctctttgcctctgtctgcggcggagactcacatgtttccattacttttctgtaatacaacaaagcaacggaatccttgggattctggccatcccggaggtacctcccgggtccgtggcggggcaagccctttttccacgacgcctcccacccgcctcgtctgctttggccgcgctcccgcgaaggccgcggcgggaggcccctgatagggcgcgcaggccccggctgccaagagaaggccgggcgcgggccaggagccggcgcctgcgagccagggcagccccgcgcgtttggaatgcgagcgccgctcaatgcgttccatatggcggcggcgcgggcccacccggccgcccgcggctccccagcctcgcgcccgccccgcgggttcttgtcgatctcccggacccacctgggcgctgggatagggaccacggattaccaagaccagcatagtgcagggcacgtaggaggcatccggaggctttgatgaatgaatgctaaatacacgacttactggtagaaggcgtcagagagtcgactccttaaataacccagcacacagtccgccagcctcggctccaccaaaaatcgatgggagcctgccatgggcgaggaccttctcttgtatttgtgtaatcccagtcccagatccccgactggtcagggactttgttctccagctttgcccaagatgacagttgggctcagagctggtgatgtgacttgcccaaagtcacacaggtagcaagtagcacgtcgggatttgaatccgggttaaaggactccacgtccagtgctctttctatccaaactccagagggaggggaccctgctgacaccttaatgtaccctggcctccctggaggcttttctcattggaatcccagagttactaagacttataaaggatagaactgtccccttaatcccgggcatgggggctaatgccagtaatcctagcacttagggatggagaggtgggaggatggattcagcctgagttcgagaccagcctgcgcaacatagcaagatcccgtctcaaaaaaataaaaaatatgccagggtgacaaagagaaactctgtctcaaaagaaaaaaaaaaaaagataaaataagaaaacaaaaaacaaaaacaacaaaaaaccccaaaacaaagcatagaaccccccagtgagctctactttgctcccctctcccagggttttgagctttaaatttaaggacaagtgattgccttaaagagaagcctgtgactttcatgttgcgtttatctaattagctataatggcacttttttttttgagtcaagttctcaccaaggctggagagcagtgatgctatcttggctcactgcagcctcgacctcctgggctcaagtgattctcctgcctcagcctcccgagtagctgggactacaggcatgcaccaccacacccagctaatttttgtatttttagtagagatggggtttcaccacgttggccaggctggtcttgaattcctgacctcaagtgatctgcctgcctcatcctcccaaagtgctgggattacagatgggagccactgcgcctggccaaattatacactttaagtgggtaaattgtatggtgtgtgaattgcatctttaaaaagctgttaccaaaaaactccaagctttgctgctcctcactagccatgtgaccctgaagagtgacctcacctctctgagcctcagtttctttatctgtaaaatgggcaggataaaagtagctgcctcaggaggttgttgtgaggttttaaggggaggaattatgtaacaagttagcatggtacttgatatacaataaaaccttgataaataataacactagctagtgtttactgagggctcactcgtacctggcactctgctaagctcttaggtccatgatctcatttaatcctctaaccactctcatgccaattgtgtagtggaggagaccgaagcttggacagatgaggcacagattagaaccctgaagcttgggttctgaaccatgagacagtgttggtttttgtgtagttttatgtttgtatggttctttttttttttttcttttttttttttttttttgagacggagtttcgctctgtcgcccaggctggagtgcagtggcgcgatctcgactcactgcaagctccgcctcccgggttcacgccattctcctgcctcagcctcccgtgtagctgggactacaggcacgcgccaccacgcccggctaattttttttgtatttttagtagagacggggtttcaccgtgttagccaggatggtctcgatctcctgacctcgtgatccgcccgtctcggcctcccaaagtgctgggattacaggcgtgagccaccgtgcccggccgtttgtatggttcttttaaattactgtaacccacttcatttggagatgctgcgttgcacaccctgaaatgaagtttcatctacttatccacctccttccaaatcgattgtttccctttctcttgtgtaggatactttataaggtataacacgcccccactgaaaggctgcacgagacctggcatctgcccagagtgtagtgggcagggcccacagcccacccctgtgaagtgttaggcctttgggaagaaggcccaggctagatgacttgctttcaagccccagcgctgccacctcctagcttgtagagacctcctcgccttggtcttgtcatctgcaaatatgcggattacgatcatatgtacttgccagggatattgggagcttgctcacaggctctcagaagccccagagcctcacaatcgagttctcctgagacccccattggcagggagatggcagtcctggggctggcccacgcccagcaagctccccagccagctgtgctgaggcggcaagtgctaaaaataacagtcacgtcttgcagggacacaggctggcccagaggcagatgggagtcagggaggaagtggtggggatgcaccaccaggactctccacctgcagtgtgaagatatgtgggtgtgtatgggggatgattcctttacccagtgcaaggcccctaactataaaggagcttggtttcaggtcacatggagtgggtggggcctgttccctgtagccaaggcactgaaaaagtcctctagtgctatccagtggaaatattacatgacctgcatatgtaattctaaattttctagtagccatattagaagaaaacaagaagcagatgaaatgaattttaatatactttaacctatcaaatttttttttatcatttcaacatgtcatcaatataaaaatacgaatgaaatattaaattctcagccgggcatggtggctcacacctgtaatcccagcagcttggcaggccgaggcaggcggatcacttgaggtcaggatttcgagaccagtctggccaacgtggtgaaaccccatctctgcaaaaatacaaaaaatgagccgggtgtggtggtgggcccctgtagtcccagctactcgggaggctgaggcaggagacctacttgagcctggaaggcagaggttgcagtgagctgaggtcgcatcactgcactccagcctgggcaacagagtgagaccccgtctcaaaaaaaaaaaaaaaaaaaaagaaatattaaattctctttctgatactaagtctttgaaatctggtgtatatttcagacagagcatctcaatttggatcagccacatttcacgtgttgtgtgagtttcaaacaatctctctaagattgtttgttttgagacgaagtcttgctctgtctcccaggctggagtgcaatggcacgatctcagttcactgcaatctccgcctcctgggttcaagcgattctcctgccttagcctcccaagtaggtgggactgcaggcacctgccactacacccaactaatttttgtgtttttagtagagatggggttttgccatgttggccaggctggtctcgaactcctgacctcaggcgatcctcctgccttggcctcccaaagtgctgggattacaggcatgagccaccgcctccggccctgagattgttttttcatctataaagtcaggaaaataatactttcctctgaggtctgttatcagtattgtgatacttgcaagaaaagcgtatgctcaacaaatgagtgctatcatcattttatcatggctatttaaacaaattaatgtgcagtctgttcagaactaaaactggatgtcacagctgataggtgtttttgtacttttcccacaacattatgctgcttctagtcatgaatcaaatcactggacttaagggtttgaacctggcataaactgatcttggttcaagtcctggctcctggtgcttgtgtgaccttgggtgagtgattttttaccccttgaagactgggtgttctctactataaaacagagatgataataatcacaccttcctgatgggttttttatgaaagtttcatggagcgatgtaggtagagcctgcagtgccgtgtctggcactagctaagcactccatgattgtttaagattatcttattccggccaggctcggtggctcatgcctgtaatcccagcactttgggaggccaaggcaggtggattacctgaggtcgggagtttgagaccagtctggccaagatggtgaaaccccatctctcctaaaaatacaaaaattagccaggtgtggtggcaggcgcctgtaatcccagatacttgggagtctgaggcaggagaatctgttgaacccaggaggcagaggttgcagtgagccaagattggaccactgcactccagcctgggcgacacaacgagactcagtctcaaagaaaaaaaaaaaaaaggccaggcgcagtggctcacacctgtaatcccagcactttgggaagctgaggcaagtggatcatgaggtcaggagatccagaccatcctggctaacatggtgaaaccctgtctttactaaaaagtacagaaaattagggcatggtggtgggcgcctgtagtcccagctactcgggaggctgaagcaggagaatggtgtgaacctgggaggcagagcttgcagtgagccgagatcacgccactgcactccagcctgggcgacagagcaagactccgtctcaaaaaaaaaaaaaaaagataaaaagattctgttattcttacactggcacccccacagtggacaaagcaagtggcttctgcaattggcatccttacgacaacatggtgaagttagaattttcactctcatggcagaagtagaagctgaggcttagttagcctctgctctggagctcagtagaggaaagtagatgctgtttgtctcactggggctaagcttttttgaatgcagaggctgtgttactctccccagcccaggctgtgagcacggtgtcctgcccacaagcttctaaatccatcagctcctccagtcccacaaggcaaatcccctcctcagttcccccagggtgagtcccagcatgacactggtgcaggacactgcccttccatgcctcagtttctccatctaaaaacagttgtgatcatttcagccctggcgttggtatcaaaagacccgagtgtgaatgttgagttggaatggccttgagcaactgacttttctttttttttgagacagagtcttgctctgtcacccaggctgaagtgcagtggcacaagctcggctctctgcaacctccacatcctgggttcaagtgattctcctgcctcagcccgccgagtagctggggttacaggcatgggccaccatgcccagttaagttttgtatttttggtagagacagggtttcgccatgttggccaggctggtcttgaacttctgacctcaggttatctgcccacctcagcctcccaaagtgctgggattacaggcgtgagccaccgcacccggccttgacttcattttcttagtttctgtgtctttgcctggaagaaggggctaatggtagaatgtgataacaggatgttaagtgaaaagggagagcccaaaacagtaatcaatatgattctaattacatttttaaaagtcaatctacatgtatgtgtttgtatctactttctcaaaaatgcaaagaaaatcaaccaaaatgttcccagtagtactctctggacactgggctcatgggtgatttttgctttcttctctatatgacttttgtactttcctagtttttcttttattttccttttttggacagggtcttgctctgtcacccaggctgaagtgcaatgatgtgatcacagctcactgcagcctccaactcctgggctcaagggatcctcctatctcagcctcttgagtagctgggagtgcaggcatatggcaccatgcccagctaattttcagtttttctatagagacgggatcttgctatgttgcccaggctggtcttaaattcttggcctcaagcaatcctcctgccttggcttcccaagtgctgggattagaagcgtgagccattgtgcttggcctagtttttctataatgagtatgtgtctcttacaatcaggaattagtaattgaaggcataaataatagttgcccttactgcccagggttgcctgaggattgcctgtggacacccgtgaggtggcctctgtgagcaagcttgtatggcactgactgcttgccctgccctcctggggtgctgccaggctggcatcagtaggtaccacagggcttgccctttggctgggggtagagggacctactgcctccatgaagatatgatctcatcgaagctgaagatttcacccagaaaggagaggaaggaaagaaactggaagcaaatacctgatttcttttttttgttgtttgagacagagtctcgctctgtctcccaggctggagtgcagtggtgcgacctcagctcactgcaacctctgccttccgggttcaagcaattctcctgcctctgcctcccgagtagctgggactacaggcatgtgccaccatgcccagctattttttttgtatttttagtagaaacagggtttcactatgttggtcaggctggtctcgaattcctgacctcagatgatccacccgccttggcttcccaaagtgctgggattacaggtgtgagccaccacacccagctgcaaatacctgatttctaatgccagtcccatccctgcctccttgggccaagcacttggcttttctggccttagtttcctaatctgtaaaagaggattaaagggtgcttgccacaccgttgagggaaggggttgcatgtagcccctcggacccttggctcatttggattaggagtcacagaaaccaagtaaggagtgcaccttatggccagacccagggagccggcagcacctggtattctaagtgcacttcaggggctgttaagtgatgaggatcagatgttcctcccatccagcaggaagcaggggaaggttctgatgccccagtcaagtctgactggccgttgggggcaaaaggtgtgactgaagcactgacaaggtgggtggaggcactaacctgtaacacctcctctggcttggaaagttttgcttcatcaactacagctggaacctccgggggcaaggcagaagggccagaacagggaggtcttctactgaggggctgtcatcgatgtcctgagacatttgtggagcttctggtatacacagtgcagacagtttcccctgagaagctgattgtctaaaagtgacacaaaccctcttccctgccacgtgcccccgaaaagcccatcagaaacctgaatggcttcccgttgccaactgaagcatcctcaccctgtacattagaaccccctgcggagacttcatcctgatgctcaggctttatcacttacgggggtgagattctgtcactggtgttttaaaaatctccccagcaccttcgggaactgctgggggtgggggacctactgaatccacccagtgaaacggtggctttgcctgcatcttgcctcccccacccttgaatcacctgtaaaagatgcaatgtcacatctttgatgcacttaacatagagctttgttggaaaagaaatcattcagtgtcttaaattatcatctcatcctgctttcaataggcccagggttaccagcaggtgctctgtgggcagggcggggggtgggggggggggcggtgggcactgctgcatctgatgctgtctacactccagttcatctgacccttctgactccctcccccatcctgccacacagaccctgccctcagccaagacagctctccgttttcaagtcggtactcttcccttttccccatcctctgcatttcacaatattctcaggctgagcttaaaggcctgaagccttccctccttcaccagctggatctgggattctgtgctttctctaagcttctcctactctcaatcataatgatctacttatctgctcatttcctccactgaactaagagtttcttgagtccagagtgcacatcttgcctttctcccttcaatgtcgaacacagttaacaggtgcaggtgtcaatgaagctttgctgaaagaatggctgcatctcatgctctttgaagagagtatgtatctcttgccatcagaaataggcaatcaaaagtgtagagtaacagctgtttctcatgggggcttgttctacaaatccccccttgggctcaacactcggtgagtagggatcaagaggttattgctaggacatcagtttcagggcctagacccatcactcgctaggccagaccttcatgtgtgacatccagctgtcagcaggaagaagtcagtctccactgcctccacagtctccgctgccacgctgtcagccgtgggaacaataaaaagcagccccagaatgtttgctgctgtcgtgcatggacgacaccattgcacataaaagcactagtgctccattattgcagttgggcctcctgaaaacccctagagctggagagggcaagggagaggcttcctctgatcttcagctgaaggactaagcatgacaggatgccaggcttagagcccagctggcctgggtttctgacccattgagactgccgtgccacgatgctccgtcacctcctttgatcctcctgtatgctgggctggagagaacaggaagggctactgacccatttttatagaagcaaccctaacgatttgagcaatggagtctggcacaggctcagcaggtggaggaagagtaagctgtcaggaaagcagcaggggagagtagtagggtcctgacttgtctcagggtctttggaaagttgggtgtggcctccaaggtgagaagataggtgtgggccaccaccaggccatgacaggcgggcagtattgcccaggcttctctctccagtctgtcctgcgtggcatctcctttgagggtcagagaagccagggagggaggcaagctggggtgggtctcattatagaaaagagaagactggggctaagaggggatgttcctgccagcatgccagcctctgatgccacctgcaaaactggtggcaccacctcaaactcagcaatggccttttcaaacctggctcagtacaaacaactcccaaaccatacactttaggaaaacttcgaaagagattctaaaaattatttctttggggttatacattgctcagtggcttggaggtcctgatcagtctgctgaaagaagtggatgcctcagttaatcaggtgttacgggattctggaaagcaccaaaggtggggcctctaggcaggaagaggaaagtttatgcccctcttcttcttgaggtgcctctggctgcacctgggagctcacagtgactgggtttcacctgcatgaagtgacgtggtgtttagctgatggaggcacaggatgtgggggctgggtgtgctcctgcgtgttggggaagctgagctgccaggcccagggtggcaggtgccctgtggaccaggtcagtccagtgggggttactgaaggtgagtgaggagctgggaggacaggaagctcctgaatgtttccagaacccctgtagctctaggactcacctgggccaggaggcctagaatgagagactttctgggctggaaggaaacttaaaagtcttcaaatccaacccccaatttgaagtcctagtggagccgtctgggtttgcttgttcacctccaatgacgagcctggacagactgcattcaaactggcaccccatcccttccacccggtcctgtttctgaccctggagaaaaagagagcaggcctgtgtccaggtctccctggcggccctgcagagatcttcctagcccgagagcttctctgcttgggtcctacggttccaagcctggttccattttcttctcatttggtgagagtccacctcaacattcggggccggagtggctcactggcctcccagtgtcgcatggtccgtgcagaggggagcagctctgcctgtctccttctggaccctttgcctttgtgggcccagcccacgtcctgccatcctaaccagatggccagcccgaagtcgacccctcagtcttgcttggatcatgccagccttcacccatctttgtgccctgaggtcttgggtgccaagggcagggcatcacagtcctctggctagctcccttctgagttggagctccctcaggagccccgcccaccctaagtgctggtctccacaatgcacttgaggaacattgtgtcgtccttcacgtaggcgtgcttgggtgactgcagtttgctgagggggaagaagagtgggcatccactggccacgttggtttcactctggggcctctggaaggacgctgagcttaggtcaggccggaaggcgtcaatggcgtgctcacggttgttctggtccagcagcatgaaggtgacctgcagggaagggataggtgggagatcaggccctacagcagcagcgcagcttggaggcccaggcttgggctcagagctgtgctccacacctactgcctgtgcagcccctcagacccttggctcatttggattaggagtcagagaaaccaagtaaggagcgcacctggcgtatggccagacccagggagccagcggcacctggtattctgagtgcacttcaggggctgttccatgatgaggatcagatgttccctccagccagcaggaagcaggggaaggttctgatgccccagtcaagtgtgactggctgttgggggcagagggtgtgactgaagcactgacaaggtgggtggaggcaataacctgtaacaccccctctggcttggaaagttttgcttcatcaactacagctggaacctcctggggcaaggcagaagggccagaacagagaggtcttctactgaggggctgtcatcgatgtcctgagacatttgtggagcttctggtatacacagcacagacggaggttcccctgagaagccgattgtctaaaagtgacacaaaccctcttccctggcacatgcccctgaaatgtccatcaggaagctgaatggcttcccgttgccaactgaagcatcctcaccctgcacattaggaccccctgcggagacttcatcctgatgctcaggccttatcacttacgggggtgagattctgtcactggtgttttaaaaatctccccagcacctttgggaactgccgggggtaggagaacctactgactcacatccagaccaaagcggcacacctgccctgccccacctgtttccccagacctgaggtctctattcttgacaccctcccctcatgcaatgctgctgttcacccacaggaaatgcctatcccccaaacccctctataagaattatggtgtgtttttttttttttttttttttttgagacagagtttcgctcttgttgtccaggctggagtgcaatggcacaatcttggctaactgcaacctctgcctcctgggttcaagcgattctcctgactcagcctcccaagtaactgggattacaggcatgtaccactatgcccagataattttttgtatttagtagagacagggtttcaccatgttggtcaggctgatcttgaactgctgacctcaggtgatccacccacctcggccttccaaagtgccagaattacaggcgtgcgccaccatacccggcaaagaatttttaatagattgtattttttagagcagttttaggttcacagcaaaactgattagaaaatacagagttcccatatacctcctgcccccacccagtacacaacctcccccactatcaacatccccaccagagtggtagttttgtaacaattgatgaagctgcattgacacataattatcacccagagtccacagtttacattggcatttactcttggtatttcactttctatgggttttgacaaatgcataaggacatgtatccaccataacagtatcaaacagaatagtttcactgctcccaaaatcccctgtgctctattcatctctcccggcacctactcttggacaatcactgatcttactgtctccatagcttttgtttttgtttttgtttttgttttgagaccaagtctcactccgtcccccaggctggagtacagtggcgcgatctcagctcactgcaacctccacctcctgagttcaagcgattctcgtgcctcagcctccagagtagatgggattacaggcacacatcacaatgcccagctaattttttgtattttttgtagagacagggtttcgttatggctggcctcgaactcctgggctcaagcgctccacctgcctcggcctcccaaagtgctgatattacaggcgagagcctctgtgcccggcctatcttcatagctttggcttttccagaatgtcatatagttggaagcattcagaacatagtcttttcaaattgacttcttttacttagtaatatgtgtttaagtttcctccctgtattttcatggcttgatagctcatttctttttagcactgaataatattccactgtctggatgcaccacagtttatttatccatccacctactgaaggacatcttggttgcttccaagttttggcaattatgactaaagctgctatagacatccttgtgcaggtttttgtgtaacataagttttcaactcctctaagtaaactcctttgagtccaaggagagcaactggctatatcgtttggtaagagtgtgtttggttttgtaagatcctgccaaactgtctttcaaagtggccgtaccattttgcattcccaccagaaatgaatgagaattcctgttgctccacatcctcgtcagcatttggtactgtcagtgttccagattttggccattctagtatgtattaatatgtagtgatacctgcctccttcctttttcctgaaaattctgctagttcaggctagcctcacggcacctcctcccagaagttttccttatttaccccacgatgtgaaggaggaagaagagtgggcagccactggccattcattccatccctccctccctctttccttcccttcctttcttccttccgttcctccatttctttctttctctctctctctcctctttctttgaggcaaggtctcactctgtcacccaagctagagtgcagtggcaaggttatggcacactgcagcctcaacctcccaggctcaagcaatcttcccacctaagcctcccaagtagctgagactacaggcatgtgccaccacgcccagctgatggtttttattattattattattttattattattattttatcaataaaatatttttaatgcctacaatttcttgtatacataaattgcaaaactttcacctgtatatgcgaaagtatattctcttgcaggtcaacagcaccagaaaataagctaagctatctaaaaaattttttaacttgatttgtccattatgtaaaagacaggatggatttaataactccaaagaaatctctatctcactgttaatcatacactaaacgtctgaatatttaatcacatccactcagaaaataaattgtaatctaatatattcaatacattgaaaataaaacaaccagtctctcttcatatatttattctctttccaaacatgttttggtctcctgctatatctcagaaatttaccaatagctgcttttaagttacaaaatacaaaacaacaatttatttcttggagaaaatcttggggattacattaaaaatgaaaattttagttcccacattcttttttttttctgagatggagtctcgctctgtcacccaggctggagtgcagtggcgctatcttggctaactgcaacctccgcctcccaggttctagcgattctcctgcctcagcctccccagtagctgggattacaggtgcatgccaccacacccagctaatttttttatttttagtagagacggggtctcaccatgttggccaggctggtctcaaactcctggtctcaagtgatccgcccgcctcggcctcccaaattgttgagattacaggcttgagccaccatgcctggccagatggtttttatttttagcagagatgaagtcttgccatgttgcccaggctgtctcaaactcctgagctcaagcaatcctcccacctcagtctcccaaagtgctgggattacaggtgtggggcactgcacctggccatgaattttatttctatataaccttcaggaagattccagacattttagctcctggactcatggagctggagggagccctagttactagatctgattgttttataaaaagggaaactgataacacagagagggtgggggacttgccaggtcacatggccaattcattgccaaaccaggactaggactcaggcttccatgctccccaccttacccccatcaccttcacacccataccttgttccggaagggccacggcagcagcgcatcatactcccctctcatgatcacgatgaagagcgacagatgggttctctttccagtgccatctccattcaggtacagccgcaggcacaacttgtagccatacttggcagtgtagaaggctgaaacgcagaagccagaggcagttgggaagtgctggactttgcagatgtgggactgggatccagtggtcaggcatgcccaaggtcagcggctcaaaaccatgaaagatggggttagaacccagcattcttctcgagtagggtgtcagacaggaatgggctcttgggggtcatctagcttagtgtttgtcagctggccatccaagtcatacactgccgggccccaccctcagagtttctcactcagtgaccctggggtgagaactgagagttggcacttccagcaagtttgcaggggttgccaatgccactggtcctaggaccacactctgagaaccactgatctaaccaacctatgttttacagtctggaaaccaagctgagaaaaacaaagtggctggtcaccatctcacggtatgttggggacccagcaagaatgaggggccaggcttcctgcctcccagcagcagtttctttctgctgccctatgccaactggctggggtcccctggaggctgagggtacatggggtgactcacagttctgccctatgccaactggctggggtcccctggaggctgggggtacatggggtgactcgcagttctgccagccattctcaggtggcaaaaccctttgagggctgaatcatacctggtgaacatgcacagaaaccccctgggcagctaaaggggccatcccatgagagcatgtcctctggcagagcgcccttctgggagaggctgactggggacatgaattgggggcaggcaggaagagggtggaggagggacaggctggcagtctgactcatctttgcccattacgttttggtagaacaggaagcacgaggtactgcttgctttttccctctttgaaaagaattgagggaaaaaggtctacaagtagggctcgaggccaccccatgaagagagctgtcccaacacagtgggatgagcgctactcctgcaggaaaggagtcccagccctgctctgggattgtgacacactccgctgcctcgttaaaaaaaaattgttttttgagagggtcttgctttgttgcctggactggagttcagtggcaccatcatagctcactgcagactcaaactccttaagccatcctcccatctcagcctctcaagtagctaggaccacaggtgcaggccaccatgcctggctaatttaaaaaaaattttgtggagatgggatcttgttacgttgcccaggctggtcttgaactcctggcctcaaatgatcctcttgcctcagcctcccaaagtgttaggattatagacatgagccactgcacgcagtctgctgcctcattttttgcacaaatatatgcactgttatattaacagatatcatttagttaagagaaacacttgccaagtaattactttatgcaagacattgtgccaagcccaggggccccagaaatgagtaagaactgagtaagacactcattcacatatgctacctgcaatcatacacaagtgcatgtgtcttactcagttctctaatcttatttcagactgtcggctctctgaggccacggtgttcacttgtgaaaatcatcatccacatccatctcatctgcacatactgtggcccacagcacactttccttcacatcccaaacccatgaagtgggtaacagttttgattcctatttgcagaatgggactgacattcagggaggagaaagggcctgaatgtcagtcagctggggccaccgctatgtgtggctgagagccacagggcagagcacggttcacccaccaacctgaagatcccagcatggttcctgcccatggtgagtggcctgaatgggcactggcctaaactggacacagcgtgtctgtcacagagctggcagttttcactgcttgcttcctgggtcctgtggggcctgtttccccaggcaggtctctgtgcccctgggaggtgttacctggggagaagaggctgacggtcctgccacaggccgactcatggcaccgcctggtgacattggtgatcttccacaggaaagtgccatcgaaggaggcctcctccatgaggcgcaagctctgctccagcttgcccagggcctggtctttctgggccagggtctgctgaagctccaccacctgtagggaagactgttcagccaggaacaccagaacccggcttggggatgggatgggaatggcgggatgtggagattgatctgccccagatgtgttttgctgaccacgcctcactcaggtgtgcgtctgcatctgaatgtgctgccccctgcctggccttccttttccttatccaccaggaatccagctcatatggcccctcatctgggaagccttcaaccactgtcctagcttagctgctctctttcaatatgttcttacagagcccttacaatgatttcatgagacatatttttctggcttccctaccagatggtctcctccaccgaaagctgggcccatgctcattgtgtctttgtgtccatgccttgcatagtacctggtatgtaaaagtagagctgggaagtttgtgggtgaaatgaaggtataattgtggctttcagggaggctgccttttaactggagcaagagttacataaataaaggctaaagcctcagccactccaactcagcgcctggcccttctaatagctttccccaataaaatggaaagaatataaatttattcttgggtgtgctcaggtagggaagccatgaatggaagtgagcatccttaaagaaaatttaatcgttaattttactgatggggaaggtcctgagagggaaagtgacttgctcagacccacacggcaggtggctctgatcacctgctgtaatggtaattgcgaatggtgaggcagataatggtaatggtgaagcaggaactaaaatccaggcctaactcaatatgagacaatgatgtaatgttactgcaaaagaagcaacattagaatggtcattggctacattaagaaaagtataggccaggcgcggtggcttatgcctgtaatcccagcactttgggaggccgaggcaggtggatcacgaggtcaggagatcgagaccagcctgaccaacatggtgaaaccccatctctactaaaaatacaaaaaatttagctgggtgtggtggcacacgcctgtaatcccagctactcaggaagctgaggcaggagaatcgcttgaacctgggagtggaggttgcagtgagccaagatcacgccactgcactccagcctgggcgacagagcaatactctgtctcaaaggaaaaaaaaaaagaaagaaagaaaagaaaagtataagctctagaataagggagaagacagccctgttggaccaagaactgtggccaagtggattatctggagtcagcctggtaccatactccaagcgtacagaattctttggagactgagccagagcgtaggatggcaatgtgaagcagcatgctctgaggaagacgtgaaggcgctggggcttttagcctgaaaagggaagcactcaggtaggacagaatctgaccctccatccctgaagggctgtcatggggactagaaggtggatttgtcttgtgggctctgaggggcagggccaggaacaatgcagggaagagacaggctgattttagcttagtacaaggaagaacttgctaagagtggaatatgtcctgcactggaatgagctgctcagggaggtggtgtcttatcacaaaagttcaagcaaaggaaccgaagcactggatgggaggttatgaccttgactacagcttctaactcagcgctcttcctggaagggtgtgggataaaggggagatacgttttgatggagtgactgctgtaagcaggatgaatgattaggaggaagcctgtctgccgctctggagacaggatggggctcagccgggcttgaaggcaaacctgcctcccacactcaccctctgctccaagctcaggatgcgctcacggtccagctggctctggtggatagaggtggccagggccaggtgggaggcctccacctccttgttgaggacagcaacaatgttctcaaacacacgcagcttcccctccagctcagccagaagcttctccttcatgaagtgctgcagggccagctcctcctggctctcggagcagggtgcccggtagcaatcgacctccaggtcccccgccacttccacggctgcctgcagctgcaggtctgacaggttctgctccagggccatgggcccagactccaggccacagcccagccgggccttccactgtttcatgaaccccaacagcaggtttaggtgggaggtctgggaggtgacctcatgctcttgcacagactgtgggcttccctgacaagagagtggggctgatcagtgaaaacagaggtggagtgaggacaggggagcagtggagtgccctgctatcaaaggtcaccaaggattattcattcacccagcaaaaaggagtggctttctgtacagtgggagggattcagaggaagaccctggcatcagacatgcccacgatgagccacatgcattgcagcttctaattctgccctgccctggagtgcaaggatgattcaggaccatggagaggggcattgggggtgggggtcattttagtgatgttctgcctatgcttaggtaagacattaggaagaacttccctgagtactgtgatgacttaatagtaggctctgatgcttgggaaagtcattagtacaaaggacatccagatgagtggactgatgttacgggaaaatcatggaggggctgcagtggggagacctggaggtctggaaccatagtggatagatctcctttctcacactcagatgcttaccttgaaggagcagccgacacctgcaaaggggcacccaattccagcctcagccacctcggggtgagcctggaaataataatcacatcactgaatgttatagcgatccctgtggctaccctggggctctcttcaatgcaccaggatccaccagggcaggagatggcttgggccacatgactttgcacactgctgttccctttggctatctcctttccaccctttaagcttccacccttccatgaccttccttcaaaacaggacctgggcccttactgtgatcctgggcagcactgctatttctcctgtcagggcacagtccacacagctccgtaatcatcactcactctctggttgccccgactggtcgggggggctctgtgagggccatggctgtgttcccagtgctgagggcagtgcctggcacagctgagacactcagaacacactgactgcatgagtaaatgcctccctcctcctgaagttcatggggaatcttgggctcacaattcccatctgcatccctccttggccatctatccttgactgaggtgtgtccactccgcacaactttcccttccagataacatccagcctgagggaagggatacaggagggtctcagtgctattataatagcaatttgaccccactgttagcctatttaggtctgaagcatttaccaaatgctttcatggccataattcttcctagggctccttacagcatggtggggaagagagggtgggtttttattcctattttactgatgaaaaaactgaggctcacagaggggaagggatttgcccaaggaggccgagctgggaggcagcacagccacagggcccctcccacgcacatcactacctcttaacaggagtcagcccaggagagatgggaaaaaagtttttccaacatatacagtcatgcaacaggaatacattctgagaaatgtgtcatcattgtgtgaacatcataggatgtatttacacaaacctggatggtataccctgctacacaccgaaactctgtgacagcgtattgcccctaggctacaaacctgtacagcacgtgaccatactgaatactgtaggcaattgttaacactgtaagtacgtgtgtatctaaatatatctaaacatagaaaaggtacagtaagaatacagtactatactcttctgggaccatcgttgtatatgtggtctggtgttgactgctacatggcacatgactgtatcttcataaaggcttgtatccagaatatatagagaactcttacaacctaataagagacaaatgacctaataaaaaatgggcacagccaggctcagtggctcaacacctgtaagctcaacactttgggaggctgaggcaagaggattacttgaggccaggagttcaagacagcctgggcaacataatgagacctcatctctacttaaaaaaattttttaattagcagtcttggtggcgtacacctatagtcccagctacttgggaggctgaggtgggaggatcgcttgagcccaggggttcaaggctgcactgagctatgatcacatcactgtactccagcctgggtagcagagaaagaccttgtctctcttaaaaaaaataaatgaataatgaacagatacaatctatgaaagtatcttataaagttaaatcatacttataaaataatttacttataaaccatacttataaagttaccatacaatccacacatttcactcctaggaatttacctaagagaaagtaaaacatatgtctgcacaaaggtgtgtatgtgaatgttcatggcggctttgttcaaagcaacccaaatgtgtcatcagctggtgagtgggtaaacaaattggtctatatatactacagaacaaccaaatggaattaaataccagcataaataataacatggatgaacctcaaaaacattatgctaagtgaaagaagtcaaacaccaaagactacatactacctgtttccattcttacgagcttctagcaaaggcaaaactagagtgacaggaagtagatcagtggttgcctcctggagctgtgggtggggaggggactgactatgcagggacacaaagcagctttatcccgtgcagaaacatttgccatttgactgtagtggcggttacatgattatttatattcatcaaactgtacacttaaaatgagtgagttttatggcatataaataaaatcttgattctataagcgctttgttatttatttatttttttttgagagaataatctcatggaaccacgtgaaaggggatttggacgaaagcaggagaggacagaggtctttcggactgagcaaatacaaaaagtcacactagttattattctttaaaagtaacataaccagagagctgtgggcttaatgagtacagttgggttgagacacagaacacagcccagcaaaggccaccctgcccccacccccacccaccaactgcccagggcttcagggacaagttgttcccaataaataatagaaaacagatgttctatggaaggcaggcagagggcggccttggcagggagaccgtgctggcttcgggaagtctgtggtgatgaaacctccccaaacatgtagcttttgacatgtgagaacagtggagggaagatgctatgtgtagacctggctccttggtgaatatacctgggggagcctttcaggtcccacccctccccacaggtccatgattccaatagtctgtggttctaagggtcaaagcttggtgggagagtcataaaagagataagaacatgaaaatgatcaagctaagagtgaaattccagacatcaccccgcaggtggaggggatgtgtctttcagcagcggagctgtcctggcgttgtgtgaacagcaaatgtctgttttagggagtgaaatgctattcagatgtagggacatccttctgtgatgcgtgtacagatgtggactgtgatgagccttgaacagttgctggagaaaggggcaggggtgacttgagaggctttcagaggcttctccatcatcattattcattccttagagtgcacgggagttcaggatgtggcctctggagccagccttttggggttcagagcttgtttctgtcacttcacatactagctttgtggctctgggatagttactaactcctctgttctgcagtttcctcatctgcaaaatggggataataataatacccccttacagggttattgtgaggattaaatgagataatacatgtaagcactggtattagttacccattgctgctgtaacaaaataccacaaacttaacagcttaaaacaacacagctttattatcgtacagttctggaggccaggggtcctaacatggaaatgtcagcaggactgcgttgctcctggaggcccaaggggaggatggcttcctcccttccccagcttctcagggctgcctgcactccttggcttgtggtcccttcctccatcttcaaagccagcagtggagcatctccccttctctctgaccctcatctccctcttctgaggacacttgggcctcctggataatccaaggtcacctccccatctcagaatccttcatttaatcgtgtctgcagagtctgttttgccattgttatgggctcagcaacccccacccaaatcagatgttgaagtcctaaccaccagtatctcagaatatggagacagggcctttaaagagctaattaaattaaaatgaggtcattgggggtgggccctaatgcaatgtgactggtatccttttaggaaggggaaatttgaagaaggaccacatgaagacatagggaggggacagccatgtcaaggcaaagagagaggccttggaggaaaccaactcgccaataccgtgccttgaacttctggcctccagaactgcgaggaaatacatttctgttgtttacaccacccagtctgtgcactttgttatggcagccctggcaaatgcatagagccatgtgaggtcacatactcacaggtcctggggattcacatgtggacatctttggaggacattattctgcctaacacagtgttcaataaatatgagccattattactaataataaattaatagtaataatggctcatatttattgaaattattccatactactactgaatacttgttgaatactactgctactaataacactaataatactaatagtagtaatactactagtattactactaattagtattcttattcctgtggattaagcactgccccgggacatctcccagtcccaatccctcagtggctgtcatatacatgtatctcatttaatcctcacatcacaaactctttaacaatgaactctctaaaactccattttcccactggatttcctcaaggtggtgaggaacattcctaaatgaacaggaccaaaatatgtttgaatgttgtcccataggatccctgtgacaatcatctgaggcaggtggggctgtattagagtcaccttaacacaggcagaaacagagggaatggcttaaggtcatgctgagcttgtgagcagaggagctgggcacacctgtgcattctctctcacagttgtgagcccctgcatgggcttgctgctctcctggcactcatgtagacactgtcccatcagatcctcacagccatgagggggaggttggggctctgaggttctgcttccctcgggtaggtggagaagccgaagcccaggggcgatcagtgacttccaggaggcaacggggcaggcgaggggagcccaggagcctggagtccgtgtgcaggctccgtcctccccaccatagtgtccttgcctggggtggcctcactcaaaggccagggaccgaggggacaggagagggaatcaggaatcagactgcattgcaggagaagaacagaggatctgtcctgggccaaccctgtctggtgtcacaagtggcccctgtgtgagtggcctcactgcttgcaaattgctaaaaataaagtgtgcagtggaatttcctccgaggaggagacagaaacagagaaaacagattcccagccctgagggaacactcgttcttctgtctgggtctgaggagtctctgcgtgtgtggtgtttccggccaccctggctacccaggccctttgtggtggggtcacagtgggccctagcggggggccccattctgagacctggggcctccgggaatgtgactgttaagagggtgctgggagcatgagtgccacctctgcagcccctgcacagaacaaagaggatctgagcaggccaggcactgcctacccccacactgggctgaggtcagggatgcccggaggggctgctgtgactcaggtctcagctggtgctgagggggtgctctacagtcacatggggagcttggtcagtctgccactgtccgcccgttcctgccctcctctgtaactgggccggtttactctctgtcagcctctgctcagctcgaccgccacctcctccaggaagccctgcctgattctcctggttgaacatagtcttgcccattcctgtttttcccatagcacttggtggactcctgcactaaagcctgactgtgttatttaagcaggtatgaaacatttaggggaggattccttgtgtagaggcagcatagagaagatgccaccagctcaggagccatgggttagagcctggctttgcctcccacttgctgtgtgactttggtccaggcacacctcctcatggagcctcaaaatattacctattggtaaaatagggctatcaccgccacccaccacacaggatgtcacaggatcggggcgattacagatgaacactgtcaagctcagaagtgtaaggtttgggggtttattcccaggtatcacacttcaaggaacacagataaacagaagcgcatttaccccaaatgcacagagactggggaaagactgctcagtgtctttccatggaggcaggactgactccagggataggaggctaagttgccttttgtgacctcaagggagacagacagacttcagctcagtacaaagaaagaggagaatgttgcatcactcagagctccccagggtaggtgtggttgtttcatggagtaatgacctctctgccattggaaggacatggagccacgtagcatgaatccagtacagaacagaaattggactagacagcttaaacccttgtcactttctgagtctagacaaattaaggctttactgtgagctactggcatcagttgtcagcttgcttttgaccttcttgaatgggcctcagggggagggggtgggagaaacaatcccatttgctgatcctcagcagacaggactgaagattatctccagccccctggcatcccctccttcactgtcacttctacaggaagatcacgccaggcaagtatcaagtctctaactaggtcaacattaatcctctaatatctgcttcttacattaggtaatcagtccatggctctgggcacttctttgggagataatcatctaatgaagtcacaggctggggacaaactgataagcagatggcatgggaagtgtttgcaaggagggctggtcctcagccctccaccctgcctccatttcccaggttgccccagatgtgcaggcaaacttaggaattaccacacatgcaaagtggtgacttatcatcagccactttcctttggtcaaaagtcccccaaagttcccactggggcaaaagtcagaggagtccctggtccttcccctatgtggctttgtgtaggtgatcagaccatgacttaccgcccctccccaccccagcttttcaccagaagtccatgactccacgaggtggggaagccagcagggaggggagggggctgatgcctctcagaggtctgcccgcattaaagaaggcttctttgctcccaaatacaggcagcttcctctcccatcctgtagcctgttagggtgcctataattctaccatgaattatagtgccttcacttggcttaaggcagcaagtttcaaactgtgctctgcagggccctaggagtccccagaacctcttaggggctcggataggagaaagaaatggggcaattaacaggtcggggctccaggatccccctccatcagaatgcttttactttcatctgattgaaaaagatgaaaaaaagccattggattaggagatattaaaatatctatgtgatctaagatttacacaataaatgtgtattaattttgttaagaggaaagaataaaacaagctaaaaacaacagtcctagagcattcaagcaggtaagggccttttgcaagtgaggcatagtggctcacagagttgagggtctgcttgtgtctcacagccgatccaccaagagccaaacagtgaggctcagggagttactccacggagcagcatatcatattaactcttaccacgttgcagagtgtaaagttccaagaacatgcatttggtccttactcttactctctgagggcctgccgatggagaggttgctgagaagcagatgggagagtgctcaaaaccagctctgggtgggacaggaaattcccctgaactctctgaatgagagggaccagctcagagaaaggagaaggaggtgtggacactcgcctgcctctggtccagcggtagggggatagctgccctgccagcactgctatcacggtctggacatcacagatcctggaaaggccttgcagagctgacttaatatcctcattttacagatacagaaacagggcctgggaattgctgctagccaagcagagaattatgcagaaccacccctggacatcaggctcctgatccctgggccacagtttgctgcaagaagagggctttggctgaaaggagccaggcacttcccagtggaggtagagagggcggctgagcaacgagactcctctgcaggtctcagggccccgtgtgtaaacaagaggatttgattttgagcagtgactcctgcctgtttggattcgtggaccaatacgagtgtgtttttttttaaattgagagattaacaaagagattgtcatctttttaattttacttagcaaaggctttgccaaaaactatcatctacgattacatcctttcatttatataaagacatgcataggacagacgcaatctcagagtaaaagtttggttttataaatggaaagaatttagtttacataaactgatttatagaattgccttatttttatcattttgtcatgagctggtgggaatggatcagttctggatagcatgtgggaacctctgagcaggacatgtaacctatgagggtccttccagcttgggagggccagggttctaaattgtagctcctgaaaatgtctctctggcctatcacacttccaaatgtgtctcttattcctagaagcaccgtttgacagagctcaggacgtgagctgataatggtctctccccacctaaaggcaaacagaggcagacagaaccatctagatgaggagtttgctaaccttttttatgtaaaggggtggatagtaaatattttgggctatgaagtctttgttgcaagtactcaattttatataattttcatgtgtcccaaaatatctttttttgtttttttgagacagggtctcattctgctacccaggctggagtgtagtggcacgatcatggttcactgcagcctcgacctccccaggctcaggcgactctcctacctcagcctccagactaactgggactacaggcatgtgccaccatgccaggttagtttttatattttttgtaaacatgtggtttcatcatgttgcccaggctagtatcaaactcctgggctcaagctctccgcccacctcggcctcccaaagtgttagaattacaggcatgtaattctatgtaatttgaattctaacacttcagaattacaggcatgtttgtcatttaccaaggggtttatatttgttattataagaacttttttgattattattgattggggctcataacaattctgtgatgcagaaaacagttttacagacaagcaagctgtggcttgagaacattagcagtgcagcaggccacacagtgagagagtggcctcacagcctcgagaattacaggtcattatgcatggcctatcattcttctgattttttcaaccatttgaaaatataaaaaccactcttagctcgttgcttaggtggtgggccagaatgtggcccatgaaccgtagtttgtggacccctggtctggactgttctcactctaagtctattgccaggtagctttaggcaagacacttcaccactgtgaacatcagtctccttattccttataaagcaaattcagtctggactcaggactagttgggaggtgcctgccaggggtggagtgggcagctgtctacttggcttcaacctggaaaaatcaagacaacggacaaatgcctttctgtgatgtgccaacgtaccttctcctgagttcgaagacggcttcctgggcttatagactggaggtcttcccctctgcatttggggcagatctgatcctcgccattcctggggaaacatggacaaagccttggagagaggcactacagctccctgcaccatccactctcctgacagctccagaagcctcaactatcagcagggtggtgatcatgtacgtccacaatcccagagccacagttcctaaatcgcaaaactgccgagtatcccacattttttggtagtttgcagtgagcttcctgggctgccaaacctgccgtgactgcactgaccggaagctattatagcccttacttgccccacttagtgtgaatatatacatgtttcattgcagaaacattaatgtgcttgattacagggcactgccgcattccctgccacaattacatgatgccctgatttgcttttctaaaaaaaattctgaattacaaaacacatctgatctcaggggtttaggcaaaagattgctgacatgtgactatatttgctcttctcatttggtcctccatttggttttggtcttatatgtttagtaattacagaggatcatggcctattagaacaagaaagggcctcagagaacatctgtcctagaggttcttaatcaggaatgggtgtcagattctaatgggtaacacctgggtacccgtgggttttttgtctgttttttgggggtttttctttttttgagacagggtcttactctgtagcccaggctggagtgcagtggtgcgatctcagctcactgcaacctctgcctcccaggttcaagtgattctcatgccttagcctcccaagtagctgggattacaggtgcacaccaccacacccagctaattcttgtatttttagtagagatgaggtttcaccttgttggccaggctggtctcaaactcctgacctcaagtgatcctcctgcctcggcctgccaaagtgctgggattacaggcatgagccactgcgcctggccagcaactgtgtttttacaaagctcctggtgtctctgacctgctaccgctaccgagatagtctattttacaagtgagggaatgaggccccagagggcatgtggattggtcaaggtagagtgagtcaggagcagagctgagtagaagctcttcaggacttaggcctcaggcctcagccctccaacttccaatcagctccctcctctgccaggttttggaaggagggagaggggaaaccaggagacccactaccagagcctgagctgaaccctgacaatccgcttgatggtaaaaccagtgaacctctgctcctccacctcctggctggcctttccacggccacagcctctcctcgctattctcacagcctcctcctttgtcgtcatgtttgaacttctcacttgcctgattcagctttgccaccttcttaagctgtaaaaccgcaaacaaaaggtcatcacatgagatagtttaagggcatatttgccaggaaactgaccaaagctgacctaatctgttaggcctcagtgttctcatttgtaaaataggatcataatagtatccacccctctaagttgtgctgaggacccaagggcagagcatttggcacacagtaggtgcataattgcttaaagagggatgtccacaatagtactgatatcatgcctttctgggttgttaatattttaagtatcattaaatacacaaatatatatcgatctctttgtcccctccaaaagggttcccagcaaacggtctgaggtgatgagcaatgctgtggaaggagagatattcgtctaacagtttgtcattcaccaagaggtttatatttgttattataaggacttttgtgattattattcattgggcttcattaacaattctatgacacagaaaacagctttacagacaagcgagctgcggcttagggacattagcagagcaccagaccacacagtgagacagtggcctcacagcctcgaggctctcctcggtgtggatggctttcccctgtgggagctgatgcctttctgtggcttcctctccttccaccacagccagaggggcagtgtcagggagtgtgagaaaagggtgtggaaactgaggcccagagaagaaaagtcaccgcctgaagtcacaggctcctctgcccctcacctcccatcaggggtccctccctggcacccactttctgcccaccctccgctcctccatcacctcacctcgggttctcagagagacagcctgcacagcagagagccctgggctcctttgggtcctggcagacggtgggagggcacccaaagggaaactcattctcatcaggggccgggcgaggactgctgcctgagctggaggccatctcagggttccaggctggccagagggcctgtttaagttgctccagggcaggggaccagccttgtggagtcctggcctgggcctcactctctggtgagtaggagctctgatgactttatcttcttctctctggcttgtgtggttcaacgtcacagctgagtcacagcagggatggagcaggaattaccctttgtggcgataaaaatcccctggatggtgactgaaggctttaggagtgtccagtcatttttttttttttttagagtgagaaaaagcaagagagcaagtcagagaaaatgacccgtgtcacagactctcagaaagcacagtgagagttcccctggttgagaatcgcaggctgccgctggcttcccccacttccctgggcacatcggaggagggggccacagctggtccctggtctgtgttccctggcacctctgagcagcctggaattctcagtgggggtgctcaccttcctggtggaaatccccagggtgttggagacaggtccaaaatttcaagttctaggcgcttttgctctgctctgtttggagtgtctgggtgacctcaaggagaagtcacttcctcacagtgggttctgatgactccatctgtaaaaaagaagttgcaacaggtggcctctgggctgtaagattctgggaccctatcttgcctgggactgaggcaaccagaaggagcaggaaagccctgatgaaatccaaggcctaggaccacagactcctcagggccctccccacaccaccccactcaggaagtcataggtggctacatgctccggtcaggtgccaccactttactgcctcaaggagaacaaagcgctaaacaaatgcaagatcacagcagctggtctcagcatccaagtgggatgtagatccacatttgcaggaaaagtgcactggggaaacgatggctcccagaatgtgtactgtgtgctgggcaacagtttccctccaaatccttacagcaacctgcaaggaattcttctgcagctgtatatagggtcagagaagcaagatgcctggtccaaaggcacacagcctctggtagtggagtgggattcacaccagggctgtggggccccaagctctgtgtgcttgggatggagatcagagtacccagctcttgtctcatctatcaaatggagaagacaatccctacacatctttccatcctgcttggctgctacagaggttttgcaaactttcacagtggtttcagatcatgggttttgaggtcagacagagctgagttgaaatcctgggtccactgcttactaactgtgggccctgggacaaagtccttaacttccctgaaactcagattctgcatctgtaaaatgggacaataatacctatttcacccatttgttgtgatgactaaatgagatagtgggtcaaagtgtggtgtgtaacccaagtgaagtacttgaatgacatttggctcagatggtgactacaggccttccagctcctcagagaaaaggattaaagtggtgcattatgcttatactgtgctttcacgtctatctactggagcctcaacaggtgggcagggcaggtcatctggcctgagatacattaaactgcccacctgccctggtgtaacaccagggctgccacaggctggtggcaaagacagcacggcatcttaccgccacaatgtacatcaggacctccacccccataacaaacgacctccaggcctgcatcaagactatcagaagacactcccttttaactgtgtaccccatacctgcaagctttcctgcagccagccctacctgttccctccttcccctggtttgggataaaacaggcacccaagacttctctccccatctgtgggtcccttctctcccctccggcctcaataccaccctctctacctgctcattcccacggacatcaaaacgtgcgcaacctgctctaataagaaaagggaaaaatagtactacttttgggtaccgtcttacgtaattttacagacatcatctcatctaattttcactctgtgaagcaggtattgccatcatcatccccaccttacagatgagaaaactgaggcacagagaggctaagcgacttgttcaaggtctcacagctagtgagtggggacccctgaacccagagccagtcctgtaaccacgcacgcttttaaaacactctttattctcgtctccaatttctacatctactctcgcctcacctaacggtagaacttctagaaaagattgtctatacaggcacttggatctccagggaatcatctctccaagtgtatacgcatgtcggggacgccaaatgccctgggcccgccccagtttctatccaaccagccctcctgccagcacctgacccggctctcagcccttccttccggaatcccttcctttccccggcttcccgcatcctctgcggggaattccccccgcgtctctggtggctccttatccgtctccttgacccctttctcttctacactgggcctccatcggctccatccacgaggagtctctctgcgccgcgtgtccccatctcccactcgtcctttggggcgcccctgcaccagaccccactcccacgggaagtctccgtgggccgccccatgatgaggctgggcgccccgctctgtgattcctcgcgcctgccggcgccagcacagcccccgccgcccggctctgcaggctgagcccccagccaggtcggtgagcccgcccgagggcgggggagtgtcgcgtcgccacctccacatatccagttgcgagggcagcgctgggagccaggcagcgccggtgcccgcggaaagaggaatgagcccctgcggggccggggcgcccgcggctgggctgggggcagttgagtccggggcggtctctgcagccgaggtgccaggtccccggctgcacccgaggagtccccgcctcagcaagcgggagctggagcggggagttcggggcgaggaagggggccggggagccgccctgcggtcccggggcaggggtgtagggcagccaacctcggcgccgcctccgccaccgcctaccggcggccaggcccggagcttccggtggagtgtgaaggacgcagccgcaccggcggaaaccggcaaggcagggccggggcccggggctgctgctccccagaccgccgcggggcggggcgagcgatccctgtgaggggaaactgagtctgagggccgggtctgcggcgccacgggcactgtgcgcccagttaactgacacgcgtgtacgcagctcctccgcttgcggggctcctggcatctggtgcagcacctgcgcgtgtttagtgctcagtaagatgccccctgaaaaaacaaacacaaaccgggaattggagcccccaccctggtcccctgcctgcccaaaatccgagtagtgagaaggtgaagaggagtaaaaccgcagtcttacctttcttggatttctccagaagatcctagcacagtgccaggctcgcccaagcttattgggttggagcaatcaagtgatagtacttgatagtacttgatcaaaatgatagtactaagtggttcaaggcactgtgcttttacaaactggatattttaaggaaccgtttctgttttcgtctaaacacacacacacacggtcgctaaatccttaagaatatattaatcaaaatagttatggaacttagtgttggggtagaattttagattaaaagctacacctttatttttgcgaactaccaatttgacaagggctccttctctgtcagatgtcttaaccttgtaggactgatggtggagggagggatgaagctgcccaccttgttggtttggttttaacagctcaaaatctctttatgtgttagggtctttttttttttgagatggagtttggctcttgtcacccaggctggagtgcaatggcccaatcgcggctcactgcaacctctgcctcccgggttcaagtgattctcctgtttcagcctcctgagtagctgggcccaccaccacgcccacgaccacgcctggctaatttttgtatttttagtagagacgggggtctcaccacgttggctaggctgatctcgatctcctgacttcaggtgatcctcccacctcggcctcccaaagtgctgggattacaggcatgagccaccgcgcctggcctagggtccctttttatgtcctgactctcaactggattgtaagagcagggaacgatcttttacttgttttttaacctggcatgcctgtaagactctcacttattggaggcagagctgctgtcctccaacttccgctagacaggcggaagctgcggaacacagggtactctagtgaaagggggacctcagaggcccacctgggagggagatgctgcttgtggacaagcagaagatctcaggggcctctaagagagaatttctgcaatctatgggcaggggcctctaagagagaatttctgcaatctacgggaggttgcccagatgtagcctctgtggggccattcaattctacgggaaaaggattcaaagagttaagtgtttgaattaaaaattgatggactcggccgggcgcgatggctcacgcctgtaatcccagcactttgggaggccgaggcgggcggatcacaaggtcagaaaatcgagaccatcctggctaacacggtgaaaccccatctctactaaaaatacaaaaaattagccgggcgtggtggcgggcgcctgtagtcccagctactcgggaggctgaggcaggagaagggcgtgaacccgggaggcggagcttgcagtgagctgagatcgctccactgcactccagcctgggagagagtgcgagactccatctagaaaaataataataataataaaataataaataaataaataaaaattgatggactctgagtcaattagtctgatagttttcccatcatcagaaaacatttaattatctttgaccttgccttttcctgggtgttgtgaagttagaaataacattccagcaaaaatttgggaagaaatctggggttatttgttgaagggagtttctaagtctagtgattttccctaactcaatagatttccagattttaagaaaagaaacaaagcacctctgaagttatttgaattctaggcaccaagcaatccctggggtttttctagttgtttatgggactggccactttgaaggcgcaatggggatttcaatttctgatggaagtgccagtgacactcatggtcaggtgatgtggttcaggggaagagcttggcagatggatcagggacatgctctaagatgccagtgatgaggaagacattgatactagccagctcactgcctctctttgtcatctgtagctacccatgtgtcctgttctaacagactggtttttctgtgtggcaattcttcctttcatggactctggaaacaaagactcttccaaaggtgggcacactgcacaagggccttttgaagaaaagtttctcaaggatttggggcctataaaagccattctcttctgtcccacccaccccttcctctctgccctaagccagtgtaagtgaaaagagcaggcagtctgacctcactctcttcatgtgccacatcctgttttcagattaatgagctcatttgctggaaatttaccaagggaaatagtttaattttggaaagtaccaaaaacttatctgtagtcattcagcttcatttggggggctcttgaaatggaggggcatcaccggaggacctctgaacgcccagggagcagcaaggcaacagaaattgaaagcgagcccagtgaggctgaacctgactcagaaaggaaacaaaatcttttggaggccactcatgtctacccagttgaatttttttttttctaaaaataactttaaaaagagaaatagtttatctggccaaagcctcatatctggtggtctgaccatggagccatgactgaggaacaagaaaatgaacacagggaagcaggcagtgtttgagcctccaccctctaccttcttgtccatgtattaatatgtttggcttgttctaagaggcacggaaaggctttcagtctccagttttgccccaatcccttagcaatccgacccttgacattgaagttgtctgcctaacctagtagcctttgtggctcctgcagccagggggattctagatgatcacagatttgcaagccattctgcattggagatgatgagatgatggagcacaagtgatgtgcaccctagactttgcctctaagcatccaaccacctcctggcctgcactgtttcccagagtagagatttatcatccattctaagcagaatgaatggaacacgtaagtgaatccagccggctaaaggcagccatttgggcaggctcctgtttgtcaacagcccttaaaatgtggagcccagaatggttctcactccctcaaccccagtcagccctttggtgccttcttcttattaccagcagcacgccttgtctctgtcatacggcttgtgttcagtaaaaacaattagtgaacagcttttctgttagcatcattttaatctgctctgataacttctgattcttgaaccaagaaatttaattaaacagatgattacaagctgtcagcaacctatcagattagaagaccaaatggtactgggttcttcaatccaaattcagtatgtccctttggcacattacacagaactgatatcaacaacaaaacaaagaaataaaacatgatcttataaaaatgacagcataacacgtgtactttttgctatggtctgattattaaaaatgtcccaaatttccttctgttaatctccatcttggttcttattacacttataataactagcatttttaaaaacgtgcctgtttacaggtttttttctttctaccacagaattatgaatacacgaaattgtaggaatatatgaaaatgtgtataggaatatatgaaattagatgaattaaaaccatgaaagtaaagctgtatctgatttcattgttgtttcccctggcttagcatgatgctagttacataggagacatcactaaatatttattcaataaatgactaatatgcaagatgctattaatacaaattttacttatggtaacaatagttaatgatgatttccccaccatcagaaaacatttattaagtatcttcaacctggccttttcctgtgtgttgtgaagttagaaatagcattctaggaaaaatttggaaagaaatctggggttgtttgttgaagggagtttctatgtccagtgattttctctatcccaagagatttccagattttaagaaaagaaacaaagaacctctgaagttatttgaattgtaggcaccaagcagtccctggggttttactaattggttgtgcactttgaaggcgcaatggggatttcagtttctgatggaagtgccaatgacactcgtggtcaggtaatgtggttcaggggaagagcttagcagagggaccctttgatagggacatgctctaagatgccaatgatgaggaagacattgatactagccagcctactgcctttctttgccatctctggctacctatgcgtcctgttctaagagactggttttgctgtgtgacaattccttctttcatggactctggaaacaaagacactcctaaaggtggacatgctgccccagggcctttttccgggctacggaattattgctctttcttcacactcacctttgggaggcttgggttccctggccactggctagtacagcacaagaataacgcagtgttcgaactcaacagctgttaacatctggctgaggaaggatacagtatgaaggttcccatctcactctatcttgaggactcagcctgagagagaaaaatcaaggagtggggaaagctgttactcagaaatcagaagatttgctttgatgttggaggactgtggcggaaagttcctcccatccttgaaccttatttttcttacctgcaaagtgggagaatgacttcaggggaatccttcagcatgaaccatttaattctttaaactttaatcattcaagccctggtcctggggaagaggcacattctcccatctgttgaggggctgttctccccacctgtacttggggtggtaccaggaacccctataacgggtgctggaagcttccactagaggcatggtctttttggactccaaacattttgtgcgttttttttttttaagggaagctatgtgaaaaacctcctctgatggatttctttcagagctcaagccaggcaaattcccagcacaagccaaggcttgggagcaagaatatgtagcaggagcaagaggctaagaaccagggtgcagctctcactctctcaaagaatgcacaagctgggggtcgggagggttgtgaaagtggagttgatgtttgctcatctcttctgaactccttgtcttacaaaaggggaaatgggggcccagagagagaaatgaacttgcacagtcagtccaaggtccagaagcctcttcctctgtattctgatgccctattgtctcaagacatcttagtaataactctgtccttttattcctgcattcgtttctccttggatatgtctccacaagactgagtttcctgagggccaagaagcagggcacagacatctctgtaggctcctttgtgcctagcctgcatcttgtacacagtgggggcccagtaatgatatattaagagggacttctttgccttcataagaggattctgggatactaggaaatattaaccctacctttcacacctgtgggttacccagatgtatttaacaaatatgtgtttagcttctaccattagcctttttgcaatttttttttgtttgagatagagtctcactcctttatccagtgttgtgatcatggctcactgtagcctccacctcctgggctcaagtgatcctcccaccacaccctcccaagcaactgggactacaggcatgcaccaccacgcctggctaattaaaaacaaatttttttttttttttagaaacagggtctcactatgttacccaggctggtctcaaactcctgggctttagtgatcctcctgctttggcctcccaaagtgctgggattataggcatgagcctacaatctttttgtaaattttaaaaataattctagcatatatatctagcaacactttctggagatcattgtcttaatcatttcagatgtgcacttgtaacattttaaaatgcaaaatcaaatagataagaaaagccattctgtctactgccatccttggttactatcttctgtaaccagtgcccagctgcacagccagagagctgtgggtagggcccatggctctctctggcccctgtgattgctgaaactggaactgcttggggagccctggggccctggcaccagctcctgctcagtcctgcttctcctttcacagggaacatgtctacacaccagctctcctgagcagtcttggaacccctccaaggacagccctggacactggccaagggggagggtgcccctgggaaggacgtatctatcaggaagcagagactgtggcaggcaggcatacacacgcacatgctcgcaggatggctggcttacccaagatttcaaaagaagttggaaatctggatttttatgtgaaacgacttgatttttagaacaccctataagccaaaaaataaacccaaaccaaatgagcatccctatgaactgtgtctgtgggccactatttgtgacctctggtagagcctggcactccataaacacaacaaaagcagatgtgtgaacgtgcccacatgtaactcacccgggctgttcacattgttcatccagatgtggaccctgcacacacataatagagaccttcattggacattgacacacacatagtatctcccgggatgtggttttaatatttgcactttccacctaaggagactgaatgtcagaaagatctctaagatcatgtcaaaatctaggctgcctgaccacaaagccagtgttctgaaccgctgcacaaaccaccacccagatgcctgcactctgaattaaaattgccagttactttgcatccttctctaaactaagctttatgaatttagagactgtgtttcatttgctggtgcatcccatcacctggcactatgcccagcagagcacagaaggtgctcaatacgtactggtgggattgtacccacaggctcatacaaacgtgtacagacagggcacatgtaaacccacatagccccaccatgctgaagaacacatgcacactgacgttcccacatgcacaccacccacctccatctcccacccgccagggcattggaccctaagctggggcagcccaagtttcccctgccagccccctgccagccttgcccaaagccttcagaaatagtttcctggaaatctcgaggcggctgtggtgttctttttcctaactcaggagacaactcagcagttttgtttttcaaagtctgagactcataaacctggaatcctttcttcattttttccaccagaattttccttggcctgttgccttcccccagggccttggctaggaggttacactcggagcgccctctgccgggcactgtcctcccaaccttgtgggcagttgcagatgggacctgccccaggctgctttacagatgggaacctaagtcagatggtggtagtgaggagaggttagaggatactggcccattgcaagtgtgtgccagtgttattactagcaagggatcttttgtgatttttttttacgtttttgaaaataaaaga

SEQ ID NO: 87 - DNA, 29506 bp, Homo sapiens
gatagagagaagagggaagaactatgtaagagaaactgatgactaccagtggtagatacagaagatgttttcagaacaattttcttgtctcttaatagacactacaaataaatgggctaatatattgttagtagtagtacacaattcaactgatacaaccttttgggtaggtaactacatgatacaaatgaaaagccttaaaaatgaacatactcttttaattcaggaatttcactttgcataattgaacctaaggtagtattaagaatgtttttataccaaagataattgaaaacatgctattttcacaaaacttgtacacaaatgttcacagcagtggaaacaatccaaatgtccaccaagtgatgaaaggataaacatgtgttatgtgcatataatgaatattattcagccataaaaagcaatgaagtaatgatacatatcacaatatgaataaacctttaaaatattatgctaagtgaaataagccagacacaaaaggcttccttttgagaatgattctgtttatatgaaatgtccagaatagacgaatccatatagaaagtagattccgctaggctcggtgactcacgcctgtaatcccagcactttgggaggccatagcaggtgggtcacctgaggtcaggagttcaagaccagactggccaacatggtgaaaccccatctcaactaaaaatacaaaaaaaattagctgggtgtggtagtgggcgcctgtaatcccacctacttcaggaggctgaggcaggagaatcgcttgaacccaggaggcggcagttgcagtgagtcgagatagcgccatcgcactccagcctaggcgacaagaacgaaactctgtctcaaaaaaaaaaaataaaataaaataaagtagattcctggttgccagaggctggaggaacggggaagaggaggaatgaggatacttacaagtatggttttcttttccttttaaaaaaaaaatgtgattacaggtaaaatttaccattttaaccactcttaaacgcacagttctgtgggaataagtacattcactttgttgtccagccatcaccatcgtccatctccagaacattttcctcttcccaaccagaaactctgcatccattgaacactccctattctcccctccccaagcacctggcaaccaccattccactttctgtctctctagatttgactactctaggtatgtaagtaaaagcatacaacatttatccttttgtgtctggtttatttcatttagcacaacgtcttcaaagttcatctgtcagaatttcctttctttttgaggcaagatgtacaatatcccatcatatgtatataccccattttgtttatccattcatcccttcatagacactttggttgcacatgtgggttgcattgcttctgtgccttttaaaattttagccaatctaatagtgtgcagtagaatctcactgtaattttaatttgtatttccctatttaatgttgaatatctttctacgtgcatatttatcatctgtactttttttttttttttttgagatggagtctcgctctgttgcccaggctggagtgcgatggcgtgatcttggctcactgcaacctccacctcctgggttcaagtgattctcctgcctcagcctcccgagtagctgggatcacaggtgtctgccaccaagcccagctaatttttgtatttttagtagagatggggtttcaccaggttggccaggctggcctcgaattcctgacctcaggtgatccacctgccttggcctcccaaagtgctgggattacaggtgtgagccaccatgcctggccccatctgtacttcttgttcaaatctttggcccatgttttaattgggttatttattttcttgctatttagttttgaaagctccttacatattctgaaaagaagtcttttatcagatatattcttcacaaagatttttctccatttgtgacttttcttttcattctcttaactgtatgtaaccttcgaagaaccgatttttttttttttttttgagactgagtctcactctgttgcccaggctagagtgcagtggtgcgatcttggctcactgcaacctctgcctcccaggttcaagcgattctcctgcctcagcctcccgagtagctgggactacaggtgcctgccactatgcctggctaatttttggtatttttagtagagatggggtttcactgtgttagccaggatggtctctatctcctgacctcgtgatctgcccaccttggcctcccaaaatgctgggattacaggcgttagccaccgcgcccagccaatttttgtatttttagtagagacagggtttcaccatgttggtcaggctggtctgaaactcctgacctcatgatccgcccacctcagccttccaaagtgctgggattacaggcgttagccaccacctagcctgaagaaccgaatgtttaattttgattaattctactttgtatcactttgttcttttttttagacaagctctctctgtcacccaggctggtgtagtggagcaatcacaggtcactgtagcctccacctcagcctcctgaatagctgggaccacaggcatgagccaccacacccagctcaatttattcttgtatagatcatgcttttggtgtcatattaaagaagtctgtttaactcaaagtcatacatttttttttcctgttttcttctagaagttttgtagttttaggttttatatttaggtctatgatctactctcatacactgctggtagaaatgtaaaatactataaccactttggaaaacagtttgccagttgcttaaaaagttaaatatacacctaccataccatctagccatttcattcctagctatttactcaaagagaaaagaaagaatatttttatgtaaagacttgtacatgaatgctcacggcactgtcatttgtaatatctccaaacagaaaacaattcaaatctcaaatgttcaccaacaggggaatggataaaaaactgtagtacattcatacaatggacttacactcaacaataaaaaggaatgaactatttattcatgccacatagataaatctcaaaataactatgctatgtgaaggaaaccaaacaaaagaatacataatgtatgactccatttgtatgatcccttccccccatgtctggccaaaataaagggcaagttcatctacagtgagagaaagcagatcagtggttgactggttgaaacagggagagattagcaaggggtatgagggagcctctgggagtgaaagatacattcactatcttaattgtggcgatggtttcatgggtatatacatatgtcaaaacttgccaacttgtacgttttattaagtgcagttcattgtatataaattatacctttgaaagctgtttaaaaaaaagtagtggtacgttaaactgcacagtgcacaaatttcagatcctatgtgacccttctttgccaacgagccaaagagttaatgcttaaaattagtcttgtttgattttcatgttctaaagcagtaatcttaggacttaaactctctcaaaaaaaactgtcaagattctaacttacatctgcaagatcagattgtgaaccaacacacaacaacttatgtggtttagccaggataacagcaaagtatctgaagactgccagatactatccagagaattattcccacaaggtgcagttggtatctactatgtatccagttctgaattattctgtctttaaattccattaaaattgttccctaaagcactgctccttcattcagcaaactatcttccccatggacctgaatcctcaaattctgcctcacttcagttcctactgcatctctgctgtcaacttgcggtatgacctctggaagtctcttcatctctaataggagaggttggacaaggtggccactctaaactctgtgagtctcaaatttaattgggcgtatactgcattatgtgctgggccctaagagggatgcagacatgaacaaaatgcggtcactgccttcaaagaatttacaaactggaaatagacacacagagaactataacataggtaatagtgtcaattatcattaacagaaataacaataatgtcctttagcagatctaaggagcagtcatttgcaactggaataattgagaaaaatattttggaggagatggctctttagtgggcctaaaaggatggacagaatatggacagacagcaaagtatttcagttagaaaggctggtatgagtaaagttaggaaagtgcaagtcaggcttaaggaaaaataagggtgccacatggtagctggagcagatgaaaagaagtggagtggaggaaaaaagtgaggttggaaaagtaggatggaaatatactgtaaagggcccaaatggcattctaaaaactcactacaggcaatgggaaaccacggaaaagattagcaccagctgactcgagatgtatgctcactggggttacaaggtgggaaggaatttgctagaaaaggaatttgctagaaaaggaatttcagaggtaaggagaagtcagactaacactacagacctagcaatagggaaaaaatgagggcttgaattaaagaggagacaaataagagacatttcataggcagacccaaataatgttaactgatagacatcatgaatggagaacacttacagaaaaggaaggaatcttagaaggtcagagccaagaaagcgctctgaaatcatccactgttgattcagtggttcataatcttttcaagtagtaaggtcacttgaaagtctttgatcacaaacatttcaaaactcttttaaatgatcaaattatcaaatacaaagtggtttttttttcctttttttccccagaatccaggtaagaattataaaatgtttttttaatctttttttttttttttttttttttagacagagtcttggctgggcgcagtggctcatgcctgtaatcccagcactttgggaggccgaggcaggcaaggcagatcacttgaggtcaggagttcgacaccagcctggccaacatggtgaaactgcatctctattaaaaacacaaaaaattagctgggcgttgtggtggtggcacgtgcctatagtcccagctactcaggaggctgaggcaggagaattgcttcaacctgggaggcgaggttacagtgagcttacatcctgccactgcactccagcctgggcaacagaacgagaacccgtctcaaaaaaaaaaaaaaaaaaaaaagggcctcactctgtcacccaggctggagtgcagtggtgcaatcttggctcactgcaacctctgcctcctgggctcaagggatcctccccctcagccctctaagtagctgggactataggcacgcacgcccagttaattttttgttttgttttgtagagacagggtttcaccatgttgctcaggctggtctcaaactccaaagctcaagcgatccacccgcctcagcctcccaaagtgttaggattacacgtgtgagccactgctcccggtctacaaagtgtttttattattattattatattattattattatcttgagatggagtctcactgtgttgccaggctggagtgcagtggtgcaatcttggctcactgcaacctccacctctcaggttcaagtgattgtcctgcctcagcctcccaactagctgggactacaggtgtgcgctaccaagcccagctaatttttgcttttttttttttttttttgagacggaatctcactctgttgcccaggctgaagtgcagtggagcgatctcgtctcaccgcaacctctgcctcccaggttcaagagattctcctgcctcagcctccagagtagctgggactacaggcacgtgccaccatgcccggctaatttttgtatttttagtagagacagggtttcactatgttggccgggttggtctcgaactcttgaccttgtgatccacccgcctcggcctcccaaagtgctgggattacaggcgtgagccaccgtgcctggcctaacttttgtatttttagtagagacggagtttcaccatgttggccaggatggtctcgatctcttgacctggtgatctgcccgcctcagcctcccaaagtgttgggaatacaggcgtgagccactgcaccgggcctacaaagtgtttttaatcaaacactacggatgtgtaaaaaatcaaaaataaaagttgtcctactattttcagacccacttccctattaatagtttctggtgtacctttgcagatatttgcaatgttatacaagttttacatgcctgtgggggttgggaagattgtaatcctttttaaaaattacaggttaaaattatagattgatataccctgcgattttctttttcattcaacaacacagagattggccgggcgcagtggctcacgcctgtaatcccagcactttgggaggccgaggcgggcggatcacgaggtccgtagatcgagaccatcctggctaacatggtgaaaccccgtctctactaaaaatacaaaaaattagccgggcgtggtggcgggcgcctgtagtcccaggtactcggcaggctgaggcaggagaatggcgtgaatcagggaggcggaggttgcagtgagccgagatcgcgccactgcactccaacctgggagacagagcgagactcgtctgaaaacaaacaaacaaacaaaacaaaacaaaacaaaacacagagatctttccatgtccacatacatatatatacatctacctcaataacttaaataactgcacagtgttacagagtaatagcgcataatttggaatcctctgttaacggatatttagattgtttctagtgttctggtgccacacacgatatgttatattcttgcatataatgttgtagggtcctccagtcgccccctttctttctctgtcctgatggaaaatcagagtgccttgattgctctctgacctagccagcggcaggtttccctagcaggcttgaccataaaccaggggccttgaacattcacaggcctgataaaggtacctaggttgttgcccaaaacactggaagaaactggcctcaaccctgagccaaattcctttaaactctcatctgaactccataccctgaccccctcactgcggacatacccaggaacacctttctcccggtgtccgtcttgacaatttctgcagccctctgcaggtttccccctaaacgcttttggactgatcgccttggcattcagtgcttctttttctgtcatcccaaccagccacatctcgggaaggtttgaagcactccctcgtgggaactctcttgccgctgcttttggggcgattccagcctcgggttcgaaagaacaaagtaactgcacattttgtgcgcgtatacttgcattaaatttttttaacaagaatgactggatgaaaaagcatgtgaatttaaaatgctgatggttcttgccacattgccaggataggatccttttagaaggggaaacaaatcaagaacctgtacaaagagatgtggaatgctccttgtaagtggacagctttgctttcctcctttaatttctatttgatgaagaaggcagtgcctcactgctcagaggcagcgaggccaggcgacgggagaaaacaccctggggcactctcagaggctgaacctgaaccccatctcctgcctctgaacccaggatccttccttctctgcaaatttcggctactttccacctcccctgtgactgggaaaagcgctgttcttgccctcaaccactctcatgtccatatttaggggtgcccctctcctcggctcaagcccccggggtcctctcacctatggttctcgttaagcagggagaagagcgggccgaggcgcagctccgccgcttgctggcgaagctcgttgagcggcactgcctgcagcacggagtgaagcgcgcgtagctcctccagcggcgcttccagcctcgctacctctctcagcagcgccaaagcctgggctgccatcttgccccccgacgcaggggctggcccagcggcccagttcccggggcgctttcctgaacctcgcgagatctgatcacagcctccttgtccctgagatggctatggggctgccaagcctcgcgagaagcctccgttagggccgtgtcaactgtagccagtggttgcggctccctcagtctggcgtcatctaggtcgctgctcagggaaatgcggaggccagtaggcttacgtgtttaccgcgtagggcaaagccttgccaaattcccggccagcggagcggcgagggtggggactcacgggaagttaaacagcctcgtcggcgtcctcgaggctccaaaaccaggctctaggcggggacgactgcagccgttatggaggccaccgcggctacggccgcggctgaggcctccccaggtggagcggtggcctggaggggaatcttgatcctgggccagccacctgtcaagaggaggcggagcgtcatgcctctggaagactggatgaatattctccaggagcctgacgaaggcgtgagtaatagggacgtgcgccgccttgttggtgttgatcagtccaccaaggagaagcagctggtcgcagtggccgtacctgtaatcccagcgctttgggaggccgcggcgggaggatcgcttgagcccgggagttcgagaccagcctgggcaacatagtgagaaacccgtctctaccaaaaagaaaaaaaaaaaaaaaggaaaaaaattagtgcggtgtggtggcacgcacctgtagtcccagctactcgggaggctgaagcgggagggtcccctaagtctaggaggtcgaggcttcagtgagcggtgattgtgccactgcactccagcctgggcgacagagcaagaccctgctttcccctcttgtcctccactaccctcaggaaaccaagaaagaccagcgtggagagttggtcgcccatctgctctaagctgctgtgtattcccctgtaatgtaaacatcgtgaaggtggagacccagttaaccttttaggtggaaggccagatgacagagggcggcatctgacccggaaggccctctgcaaccaggccaaatacatctacagggaaccaatgggaaacatctggggaggacaacccaaataagtatcatgcgagcaagggatggtttgagaactttaaaaatcgctgctgttttgcaacatacgaagttgatggggaggaaggacccttaaatcctgagtgggtatcgagtattccaagcaactggagagaggctttgtgcctcaacaggtcttcaacgccaaggagatgacccatcttttgcagtgcatgccttcctacttttggggcaaaagacaaaaatctggaaagcttagaggaagctaaggacaggatttccctcatttttttgtggcagtgcctcaggtgacaaaatgataaaaccactgctgctttacaaagactctaacaccccacttgtcttttagagataaacgccttcctgttttcttgtaatcacacccagaatcaccactgccactttttggattagttttacaatttttttatccatcaaatccgaagtcatttaacaaaaaaaatctggaaatcagaatgttgctaactgtggacagaggtcccaatcacccagattcattattctttgttcattctaatgttgatactgtgtttctccctcaggaaggccctagctttcttcagcccttgggtcagggtataactgaagcatttgaacataatcaagcatatgtttgaccactttgctgactgtattgaaaaaaccctcaccttactctgaaagaagcatggcaacagtacaatattgccgatgctttggtagtgataaaagaggtgatgggtgatataaaatcagccactcttaagcttgctggaaactgtgggaggatgtgtgaatgatgcatatttccctagagctaatgaagaagttaaaaaaaatcttagtgtctgcaaaacaggtgggtttaagatttattgatattagggaaagtgaaattaatgagctactcaagtttctgtctttggtcatcactgagagtctatttccataggaagaagtctttgcagaggaaattgaatgctgtctgatgctacaattcatatggatcctttcctggattgaagcctgacttttaaaaaaggtttcaataaattgcttatacctatgaagagatgcaaaagaaccttcaaaataaagcaaaggacttgaagaaagagaaggaagacatgaagaagaggatgtcatttaggtgaaggtgatggatacagaatctgagtctgaggggagcctggttgacagagagacaaaaaaagaaattttttttttctgactaaaaaaaaaaaggaaattttgttaacaaaatcaagaatttaaaaaaaatgctgtgagagctgatctatgcatctggtttgtgagccagtattctgtgatggctgcagtttttagagatcctagtagctctacacatctgtcttctgctttcctagaacctgggcaccccatggatgactcactgctggttttgtgtgtgtgtgtgtgtgatttaaaattacattcagtcaactctatagccctatgggctttttgaataaccaaatgctcaacagttctgtaatctttcaggttgctgtgatcagtccccaaggagtctacactctcaaagagactgggaaaggcctgtgagacaatgggattcttttttctagaggtgtaactctgcctgtgtttgcatgccacctccagaaccactaaaatataatttctcagtgggtgactgagtaagactggcagcaattgcaaaagcagattcatgccatgtgtcactcttcacagtcaggaacttatttacctcttggaactttccaaaggaacgatgatggtggcggtaatgtcacattagtatggagcccttaaattcagcagtgttcaacctgagggaagacagagtaggtcaattctcttggcagcagctgagggaaggagagagcagggagcagggctcagataaggtttgtttggcagggtccaagcacttcatggaatggagacctttggctgtcagagatctgaggaagatttgtcagggcctgctacactctgagggcttgcagtttggatggttgggaacacttcttccttgcactgatggtgctcctatttctatgacacgtgtactagttcagacacaatttattgtgttcaccaattctatgcacagcaatcagactgagattgaaatccagtataatattaaaggtgatctgggccaggcgcagtggctcatacttgtaatcccagcactttgggacgctgagttagggggatcacttgaggccaggagtttgggaccagcctgggccagaaaatgagaccccatctgtaaaaaaaaattttttttaggttagccaggcatggtggtgcatgcttgtagtcctagctacttgggacactaaagtgggaggattgcatgagcccaggagttcgaggctgtagtgagctaagattgtgcctctgcactccagcctgggtgacagagcaagactctgtctctaaaacacacacacaaacaacatctgacaaggcatttcagcctggagtcagtcaaaaaatcttagaggtctgtaaaggagatgactatgctgttagggctgtggtagaaacctttaataacaagtgaaaagagcttgtatttgccaaaatgaacacaggatatgattctttttttgcttttgctttggagttgtatcagctctgtgcggtcacatgggtatctacaaatcaaagcacccatcaaccagatgcatctctgagagttaacagcagaaggtggcataataaaagaagttctcggtagtgaaaaaggttggaaaccaccagctaaaccaatcctcttgtaccaataggagattcaagttgagaggtgggaaagggcctatctcagagtaggtgcttgaatacttcttactagaatgaaagaaggaacttaagatcacacagccatgttactgcaggacggggaatggaacctaggtcttcttatttttggttcagtgttaactcccattctctaagcagactgggcctgttattcaaactgccttcccataggtgcttccctgcttctctcctcacccagagaaggacttacaaacagcttatcttcagaggttttgtgcctgatagttatggaatgtgctggtttgagcagggaggatgtaaggggagggaatgctaaaagcctgtctacttagagtcaggtttcctgggtaagtccctggaaccccatccccttcccctttcttgagaccccaggacttgctccagtaactgccaccctgtgcctttgcttcagggccatgctggataaggagctggctgcctctgtgaacatcctactcaaggcatcttcactgtgagttttgctgttgccattggagggggagtggggggagtgtggggagtgctagggtcaggtcctggctggtgtaaagaacactgaattaaaggaattgtcagaataactcaaaggcatttagataatcaacagtccatttcagtgtttttattcagagatcgatcgatcagtgggatgttgtccaacaaaagcaaaaatagactgtatagagaaggaaggaaaaactgcataatttaggaacagtatatcttgtttgcacattctttggttaaatcaattagcctgctgttaggaaggaagtctgggcattttatccttgagtaaaccaactagggatatcagagaaaacagtttccaatgcttttggattctccagaaaacagacagtttagcatatatgacaggctgcttctgcgtattgtctacctttcatttcattaacaacttcactttagaagcctggtctgcaccatttccctcatcacaatactttagcatcctggcactagctgtgcaggatttgtcgtacgtcttcctttccctgatgatcatgtttctcatttccttccctctctcccttacaccctcaaaagagagagacataatatacattctcaaggtcatataagctatataatgaaagctacctttttctccccagtgatgttatttcctcagtggctcacaccatctgtagtcatagttcccaaatttggccatgcggtctatccctgaactccagcctcaatctattcaattagtcgccctgaggatggggcccaggtctctgaatttttaaagacttgtatagataagtcacatttagccagtctgggaaccagtgttgggaaattgaatagaatttcatcctactatttcctttatatgcccatcctttctcgtgatgtattattttgccacagtcctgtgacacaggaagggccagtggccttggtcatcttagatttgcccttgttgatcttctcagggtaaatgtctttcctttcccctgatggtgttcttatactgtcttctgatcatcatttctgactttgttttcagcatctaaaagtttccataactataaggcttacttcttccctgcagtcttccgtgtttttagttattcatttatgggcactctccttggaaagtcagtgatcaaaatagcactagtgtgtaggatgagcactggaagagctcaagcagagaagacataggagtttctgcagggctgtcctggggtggttcttgatgaggccagttggggaaaaagctaggtggcagatgttggcacactataagaaaaagcatcttgtgaaaacctttaagttagatggacttcatcaagagatgatgaacctcccacctccaggaatgttcaggcaaatgccagatgcatgcattggaatcgttggaccagatgacatgtgaggccttggtcaactctagacttgtttatataggcttggaaagattttaaagttttctcctcagtaggtcacttaggtgggccaggtttgacacttcactgagctcctcttaggagcatcataatttggttttgttcccttctccaggtacttttgggagggaaaaatagaagccactaacatcctgttagtgaggatgtgagtgtagggagtctttttttttttcttttttttttgagacggagtctcactctgttgtccaggctggaatgcagcggcatgatctcagctcactacagcctctgtgtcccgggttaaagcgattctcctgtttcagcctcccaagtagttgggattacaggtgcccgccaccatgcccggcttattattttttttgtctttattttttggtagagacagagttttgctatgttggccaggctggtcttcaactcctggactcaagtgatccacctgcctcgccctcctacagtgctgggatataggcatgagccaccacacccagcctgttgtttgttttttcttttcttttcttttttttttttttaaccattagtgcaaatgtcaacatagtaaaaggataaataataaaataatattgttatgaaagtagttttgaccccatggaccccctagagtcctggagatccccatgggtcagtggaccttcactttgagaacctctagtataaacctttatcattcagaagtggaatttttggaattggcatcacctgggagctttcaagaactgtagaatctcctgctcaccccagacctaccgaatcaaattatagtttaacaagacccccaggggatttctgtgcacattaaatcttgagaagcactggtctaaaccagtgtttctcaccgctggctgctatgtattagcatcacttggaaacatttttcaaactaccaatttaggccccacctcacagatttcgacttaatttggccagggcggggatcaagtatagtggtactaaaaagcacctttctttttagatgactctaacgtggtcacctgaaccttctgaggttgactctaacgtagggccagagatgcaaaccacctatatggatgatgaaaccttttctttactccttagggaactaagattctgtgaatacaccgttcccctgggtctcaaactagctctagaggaggccctcatgataccacctcagcagaggtgagagagtaaggaaccattggtagagccagtactgtggagaaattaaaatttaactggtgagggacagcttcagggttaagagagttggacctcctaccttgaaacctggctccccacctgccactgttccatagtgcttggaaaatatgaatattttatgtgcctcagttgccccttctgtaaaattgggattatactaatgggttgttatgcatatggaaattaatatgtgaaacctgtacatgaaatgctttatcagtctcagctcttattcctaatgtgttaaaaatgtctttgaattctgtatgtctgcttataaaaacacataagttaacaaaattcattatcctcaggcacccaacgtacagaatatttaagcatacatttgaagcaacatgtgaatgtatacatatgctgtgatttattaagcatgttacgggaactttaaaacacctcattcagcagaaaggaggcagaggattataatcctcatttgacagatgggacactgaggcccaagtcctcatgttccttcagtctagaaagtgaagagaacttgcactgtgtgacaagggccaggcgaaagacacaggagaggaagatagattcctgtagaccttgtttgtcagggaagatcccttgggaaaggtcagtggttgaattggaccttgagggacagagaagtttttttttttttaagcaagaataggcttttgattgatcagcaggagcaggtggaatctaggtgggcaaaagaatacagagatactgggggaggggggattgttttgggaagtgatgtgtataggataataataaaaagagtagctcacatgtaatgaatgcatacagtgccagctggtatactgggtaagtgctttgtataccttgtgttaattaatcctcagcagtccagtcatgtagggccttttttttttttttaaaaataggagcatttaaagaaaactaagtgacttgtccatagtcagacagctagtaggggcaaagttagaatttgaacccatgtctgtgagactctaaagctatctggcctaactggccacttattgacagatgggaaacataggctagggagtgacaggccgtgggcctggacaggtggggtgcggcaggttgcagagggcctcccttgaggctggccagttgggttttatcacgagttgattctaatcatagtcacttatagggctttgctttctctccaaaggctgtacatccttttgaaatcccagagatcttcagtctccctgtggattaaggagatgtgcagtatttaaagtggcttcaggaaggcatggaagaggactgagtggggaaagctttttgtgcatgctgctggctacctccagcggctgcctccagcctccatcagctgcactctggggaagaggaggctgccttctacctcccagcatctctggatttcatgttcctgtcagcacagaggagctaaatggcctgtagaggctgaaggtctgaggctcctaaagctggaagaaaaggctgggccagtcaggccaagcaagaacacagtgtaacttgtctctgagtgcttcatggttaagggggctaagcaggcacaagggcatgaggatggttatatgtacagactgaggggaagaagcagtgaagatgagacttgccatcttcttgagtcagtaggcctgcctcaggtgcctaggatgtaattgctctgctgcttctcatggggaggagtggccctcatgaccttgtttacctggaagagtgtgggatgaatgcctcctcctatggggactcgcaagtgctttagcaaaaggataaattgctaattgtggcatttcgtggatcagcaggattatttctccttgctaaagaggattttgttggtcctgaattctgaggaggtgggactaggaatgggctccatgagcctgtgtatgactcagggaatattaggactttggcacagcctcatgggttgggagtaagtcttggctcttccctagcctgaatgacagacatcagatcattctggtgctttgtccatgaagatgtagattctgagcccacccaactaatcttttcacttgagcacagaaacagccccgggaatcggacagacccgtgtctttcaggtttgcttcacagagccccaggggttgacaataggtgccttggagactgcctgcatggggatttttaaaaagctttctttgttaaaggtttgtaaaccactcctctgagcctgttttcattttatagattattcagggaactgaactgcacagagatccagaaagtgggtagtgcaggctgtagtgctgataactactgtactacttggatctttgtgctcccaaataccaaatggaagaggatctctgagagtcctttgcaaagatcttgtagggactttaggctggggccttcggaaaattccagaggattccaatggagattttgagggactgactcagaagaacaaagagaatgataatggtgatgtccctgctttttacaacagatcatgttctgatatatatgcaaatctgtgtaaagtaaaccctacctaaaatgtactggggacccaagatggactgcctgtattgcttccaggataaagtccaatttctagctctggtttttataaccttgcttcagctcaccttttccgtcatcatcccctccatctcctctcccacgctgggaaatggatggctgcactatactgtgtgatgttattgctatgttcatgccatcccctctgcctggaatgcccttctgcatgaatgcctgtgaaatgttgttgctcctttgtatggcctggcttccgtggttggcaggaatctcttctttcgtggtattcctgtcatctttgtgcatcacagtcagctttgtattcctagcttgtaagctacttgaggataggggcatgtctgaatctatttaatctcttgcacctgtttggcaaattgatgttttaagtatttaaataactaaagctctctctacagtacatactcacttttgatttatgaattggcaaaattcaacttttttccttgaatattcttaaagtgagatgaattccaaaggagagtgttctgtgtgtggccttcattgagtggttttctgttaccagaaagctcttggtggccttcctcttccctggtgtcaaggttgactgttataggaaatgggaggggagagggccgtttctgccacgcattgtcctaggttcttaacattatttaatccttataatgcaatgttatcctcattttacagatgaaacctgagaccaaagaacatgtaacacataaagtacattgcagagttaggatgtgaacccaactctgattctaaacctaatgctctcactctttcattcagaggttcagtcagttctttgtaggctgtagatccagagaagctgccgtagccaacaatgaagttgttagtttttaaaacatctatgtggtaagttggtctggcacttaaaaatgtattgtttcccaggcacggtggttcacacctgtaatcccagcattttgggaggccgaggcaggcggatcattaggtcaaaagattgagaccatcctgaccaacatggtgaaaccccgtctctactaaaagtacaaaaattagctgggtgtggtggcgcatgcctctagtcccagctacctgggaggctgaggcaggagaattgcttgaacccaggaggcagaggttgcagtgagccaagatcatgctactgcactacagcctggcaacaaagcgagactctgtctaaaatatatatatatatatatattgtttactactcaccacagatctgcaggagttcactgatctctaggatctgccttaactccaacttacatgttttggtcactattacaaactgtcatcccagaatgatgctgcagaggctagggctaggacacagaccagtgtttccatgtgggaattccctcccagtatttcttaggaaatgtatgttttttgaatccataatccctagaaaaatcagttgaggaaatgagaagtattgtaattattctgtgaatagtaacacttaccattatggagacatcactagtttgaaagaatccaacttcatcaaatattaacgtaccgagttgaaggctacaagaactgagacaggagcatagcagagagaaacggtcaccatctcattagccctatttttggttgttgtgatgccattacatctgtatatctggccatatcagctgctaatggtgagttcttgcaaacaaaatgatttgataaacaacctaccatactttatacaaatcttatggtgttccgagaaataaactttggaagcaaaataagttaacagtctggacacgattgattctatattctgtttaccttgctctaggctattcaaatgttatatttatttgaacactatccaatatatgttccctggcatcttcctgtcttttaaatattctctgtacgctacagttctttgtaagtaaaaataagcttaatatgtctacttagcaaacaaagtttttccagatacctataataatgaggaaaacagtataaagaatgaagtatttgaagaataacttataatttgggggatttctgagaattctacttctttgtccctaatttccgaaggtaaatgtttgttgtgaatttggaaacactagactacagaaaagcaggcactctctagcctgggaggcccactgatcttaggagggtccatatagctgcttattgcagaccttgcactagaacccaggtcttttgacacctggtgccacttttcattccattccattaattatagcccagagaataaccaccaccacccccaagtcccattgtggttttattctgaggacagataaaaggttgaagctgatggagtggtagaaagaagtgggagccatagtgaatgaagacgtttaagggcagatattaacaccactgagtccttcattcgggattacaggttacactttacccctcaaactgtagaattcagtggaatccatggcctttacctctctatagatgacctttttcctacccctttacatctcctgtttttttcctctccaaactgccctaaatttagaggtttattttgaagtaataatcagtcacacacagcaaagtctctcccaacacatggggagcagatgtgctgggattatcactgccatttgaagggtgataaaactgaaggaaaggaatctgactaaagtggcacaggttagaactagcagagtcaggtctagaactcatttcatatttctagaattgtgtgatgatgtactgataaagttttacgatgcccggatctaagtattataatagtgtcaatttctaagttcattttccatcttttacctctcagtggcactcaactaatgttttttgcccccaaaggtcgggtactcacaaaagattccatattctctctggcagtaagggtgagaatgttgctggcagtggtaggagtggcaaggtggccagaggacagggtcctgccattcctcctcagcctccagtaaaccaagtgcaaaagccagagccaattccttctgccacccagcagctaattcactatagggaagacaagtgattgttcaaagggaggttttaaatcataaatcagacacattaattataactttaacaaatgttattaaaagcagcaattaaaaaccatgaatctttttgaaggtgcagagggttataaggtcagttggcagtaatgcagctattatctggtatgaatgaaatgctggggtggggagtcagggtgacctcattaggccttgtgctatcttcccaggtggtgcagacaccccctccctccttttccctctccaggcccacagcctccccagagcccaggtagggaaggtccagatgtactataacaggattgctcatcccaggctatctcagaagtctggaaagcaggcctagaaggttgctgggctctctgaagccaggcaggaagctacaaattggatcccagttcccacagcacccctgggctaggggttggcttctcagctccccttccacctggccctagttggcccctgtggcagcagctgtggggctgaaaagggggaagaactgggtccaacgccagctcgtctatgcctgggctgtgccagggaagcagaggaaagtgggtgggctgtgcacaggaggtgaggtcccccttaaaaggcactgtgggagctgaggtctaagatgggggggcatctaaactatctcagggaccccctgaacgctcacaggtagagaggggtcaggcctagcaatggaaaaacagctcctgcaggcctgctgccccgccagtgcctcttgctgtactaccaccttcgccttcctgctggcggcctgcaaaaccagccaagctggaggccacagcagcagttggcaaggctggtccccatctggtgcccaccctccacgtcaaggcacttttgtccattttccaatcaagtgagtcagtttctaatatctctggaagcagcaaaacatcaggggtcctcttccccctcccaattttggtttccctccagatgaggcagaatttgaatgttggttccaaaaattctctttcaaacccccactggcaagggcttccctttgagggaaccaaatgatgcaggctctttaaaaatttcaacctatcccaaaaagtgattgtccatttcagggcagggcaagggatatgaaagagggtgagtcccctgtgcttccctatgggaccaatgctggttgatgggctgaaagaaggagcggccactgagctttcacatttagttgcagcacctgggccctggaagtgggccaagggaaagccaagggaggagccagcaggcccagagggacggtgtggctctgtgtgtgtacacttgggcatgtggtggtgtggccgtgtggggttgtctgcatgcctagagctgaaagtacaacacatgtggatggaagcttgtgcgagtgggtgtgtattgtctgctgtgtggtgtctggtgggtctggggatgggaggcaccagaaacaggtttagcaagacatggtttccctcccaccactaccaccccccacccccgtcccccaggtttggaaggatgcctccattccagcaaggccaggcccagctctatggcgactgagggggtgaggccagagaacagaagacttctgggacctccaaagctgacattggcagccttcactctcagccttaatacctgggccctggtgctggtgccttctgaggcagacccagccctttactcttcagatcctcacaggctttcacaggggctctctcccatcccaccacctctctccgagggtagtggggagtggcaggaaagtggaagagaaaagcactgagcagcatcctcttatccaccttctcccatgctctctcaaaggtgcctgttatgtagtccctgggaggactggctgccccacgggtcacgtgtgaaggggatccagtggagggacagctgtgcacacacaggatgtgcgaacacacccagaaaggggcgagagaggtcaaggcacacaactggggacaaagacctgggcctcaggaggaagggtcccagcgcaggggacacaaggtcagagaacagataaacagagtttgagggggtgtggagtgtgtagagacacaggcacaggggtaacgagcctgaggaggccctggaacagagctggtacagcagagagacgcaggccttggcctggcaggcaggcaggcagggcattctgccaggcacttgcagctctgtcctgcttccttctcccaccccagcctggagaaagctggggagcctatggcttctgctgctcctcctttggttttcaggacccctggcacccccgggggctagtcagtaaggggtggtcccttcccactccaccaggtactgaaccttgccctcaggtgtgaccctccgagccaacacctggtacttctccccacaggccaaccgcccagctgcaccaaagtagttggtgatagatgacttgaggtgggacagggatgagtcatcttcactgatgctctcaaatgtgtggctgtcaatgccttcgtctggccgctcggggactgaagccccctctgcactgctgtccgaggggcagcgtccatccagctcagctgcccaccgctttgcccgcaggggcatgtatgccttggctgccagcttcctctttcggctgcccactgtccatctgtatcagaagtgggagaggaagatgatgagaatgaggtagaacaatcacagtaaattcctctccctgagtcctcccctcagtaccaggaaagtggaagagaaaagcgctgaacagcattctcttatccatcttctcccatgctctctcaaaggtgcctgttatgtagtccctgagataatctatgccttgggcatagattatctcaccagatcctcacaagagccctgcgaggagggaaactgagggtccagaggagaaaaccaggtagggagtggcagagccaggattcaaacgtaagaacgtccaactccaaagcatatgctcttagagctaggatcccggcactgcaaaagcacaagagcaccattctctgagcctcctgaggccatgcagtgcagaggccctgcttatcccaccttgcctctcaccagactggtggaacaagataggtcacatagggctgggggttagggactgaaggaccctgtaccctagagcctggatggagagactgacagacatcacacacacacacacacacacacacacacacacacacacacacacacgggtgttagagaaatggacacacagacacacaggacaaggcacagattcagatgcttagagacagaaaccaagacctgaagtgctggtgaaaccaaagaaacaggaagaaataggccaggcatggtggtgcacgcctgtagtcccagctactccggaggctgaggcatgagaatcacttgagcctggcaggcggaggttgcagtgagctgagatcatgccactgcactctaatttgggcaacagagtgagactgtctcaaaccaaccaacaaacaggaagaaagaaaaaacaggcaacagcagaggacacctagacagatgtcaagagacacagactccaagacagacctctacaggcattataccattgtcctttttttttttttttttttttgagatggagtcctactctgtcacccagctaattttttttgtatttttagtagaggcggggtttcaccatgttggccaggctgctcttgaactactgacctcaggtaatctgcccaccttggcctcccaaagtgctaggatgacaggcatgagccaccgtgcctggccaggcattatacttttaattctacttttgcaagggcctcaagtatcttaaaatacagtgcagcttgagtgcagaggaaagccctgtgctcgaccactccccgtactgctgaggaccagctgttgccagaccagttgtactggagataggcccccagggatttctgtccccactcctaaatcttccaccctgcaggatgccatcttctgtcaggcttctaaataaacggctctttcccttagagaccccggaagacaggcaccatattcagacagccaagaatcaaggtcagggaactctgtagtccaagaggcagagagacacccaagctcatggcacgtggaggccaaaagtgaaagaaactctggtccaacaaccccagaactggaatcgtccagtgagaggtgtgtacaagcttctgcagcaggtgaagcattccaaagggatggaaccacgggaggctgaatgcctatacttaggtcccatctaaagccccgtgactcagaaccagagggtccgagagccagactcacaattgcagaaggccaggtactccccgccagagactgagacacatagaatgagccacacattacagaagtgggaggtggaggggctgagaggaatgatggtccttgcaaaatgtgaaggccagacctctaggaagctcacctggagtcataggagaggctggtggaggcagagccagaggtgctggcagcgtcggtggagtcgacatctgagaagaaggtctggcctgagctggcactgagaggggcaagaccgtgagcctgctggtggcccggcccagcaagttcctgccaacctggcccgcaggttcccctaacatgcatccttcatcccagtggaggcccgtcttcccacagctgagcttcccaccaccacacctgtctgtttcctacccagccacccttcaaagtccaagaagtcaaaaaaacctcctggagcaccctcccctggcggtgacgtaagcactggtgtcaataactcgagcgtgatccaaggcacctgtgcaacacttcacaggtcaaaagtgctttcatttgcattatcttgtttgaggaaaagagctgaggaggttcagagaggttaagggatttaggtaaaactacatagctagtactgataagcagggtctggagttcaggtctgactctaaagccctcctctgtgtcctcaggaaaatactaaatgacctttaataatttggaaaataaaatgatggaagatgcagttcctcccttggacatacttaagcatggggtgctatggaactacaaaggagggcgtccagcacagcctggggagggttagtaaagccttcctggaagaagcagggtcctgagttttcagatgggctagggcaaggcaaagggtatctcaggcagagggagcaatacgagcaaagatgagcaagcatcaaacagcatggtgagtgtggataaccatggggcaaggtggggagggctggagaagaggggagggctgtggtgctctgggaacagggatgttatgctgaaagctctactgcaaaaagccccttcagacagacctgcacagcagggatccttttaactgagggcttggctttctgcttggttccctccctgtctccagagcagacctctgtgctaggtccctcactgatacctttttaaactttgaatttcatccagcgtgaagtcaaatatgctagccaggtggtggttggtgctccaggctgaggtgaagtcactctgtggacacaggaaggagagaggaagggtcagacagcgagtatcaaatccacctcccacacaggctgcctcctatccagccagggccgctgagggctgggccctccctagggtaagaccatcacctttattccaagtcctgaccagggagccaaagtcatcccagttctagccctgcctttgtctctagctgactgtacgaccttcacgtctctggacctcagttacttcaactgcaaaatggggacaataacccctgccttgcttcactcttacagatgtcaggaagtgcagtaaaattaaataatgcttctaaaccgcaaagtgctgggacatgaggcattgctaatactactgcccacagggagggcttcagggaggtggtggggttactgaaggaggaaagaaagtgctctggaaccctggttccaggctgggctctgccactttgatgtgtggcctcaggaaagtcactgccccacccttccctcagtgtccctacctggacagtggggacaagaatattacctgcctttgccccccaactttggattcctgggagaacttggggggagataaagcaggggtcttagagtgcctggcttagctgtaatagggactggcttctttaagggacatgagagagtcctctgggcctgggggacttagttttcggcacaggaagccctaatatgtgctgaccctgcgtatgaaaatggagagtaagaaaacaaggaactaacactgggaatagcatcttccagcaaaaactttgatctttttcttctataaactcgccttttctgctgctggaattcgtgaggcaacaaactgtggagacagaagagggagaaggtggccccgtcagagcctgagggccctagggtggcccagagggaggcgccgcaggggcgggggtcacagcagttggggagacaggctctgaacacagctgcaccttcacagggaggcctggggaggagggagagtcctcaggagcagtaggggtgggaaggtgtggagaaggtatagtgggcagaaaaagaaaaggtgcctccccaggcacatgcatccagatgccctgccccccagtgccaggatgagggggctcagctgagccaggagagagagggacccctcacacaccctgccttccccttcacctccttgcccaagtcctaatccagcaaggctgggtcctcagatctggcttttcctccttgcgaggtaataagggggctgtggtggtgaaaggagttggggatctgggatctgggatcccgctcagccactatctagccctctcagggtcctacagctgggactggctgggtgcaggtcctccttgcttgcttggaagcagagaaaccgagtttggcggcagccctggcccctgggtccccgagcactgacccaggcttgctctttcctctcttacgcagctcagaggaggcgctgttctcatttggcagcagtcctttgtcaggcagcagcttccctggcgggttgggtgggacgcggatgcgcaggcggaagatgcacttcttcttcttgatctccttgccgcagaggaacctgggggtgggcagtgggaggaagaagctctggagtctgtcagtccatcctcctggggagtggggtcaagcatgacacaagcctctctgcctccttggacccagagctaaaatccggatggtctctgcagatgctgacttcctcaaagcccatgggatgcggggttccaggtagcagctgagaacacggctggtgcctcctccctgtgcttcctcctgcatgagtgtggttcttgctgctcttctcccttttgtttgcctcaaccagccccaaggccacctcctgcaggaagccctcctccagcttacagtggaactcctatggtcaagatactggaatctacttcattctgttctctggtttccccaggagactgaaagcaacaccggctgggctcctctgaggctgcagaagtgacttagacacagccctaccctctttagtacaagaggccacctgccctcccaatagaggactgtccattgggagggcaggtggcctcttgtactgaagagcagagctttgtctgggccctaaaccatgagaatgtggaagagagagtggataattctacccagaggtgtctggaagagtttcagcgatgaggaccttattttattccccaccatgacctcagcacccagacaggcccgacatagaacagcaactcaatgaatacttgttgatggaacgaatgagtaaaaaagactgaggcacatcctagacaaagggcagagcatgagtaaaagtgccaggtaggaaaccaaggactcaggatggctggcacccagaatacagaaagcaaagggacagcggcagaggacgcgggcacagcctggtcttaaaaggccttgagtgccaggttcaggaggctgggcatgcctctgtggtgtagtgagggacatggccagctgtgtgtgctgagaaccctggatgggaagacaggggctgagggatgtcttccacccgaggatgtagcccacccgagatgatgcacccatccctcagtgcctggcccccaaggcctagatgtctagagccggaggggccctcagagagcaggggtgcagcccccctacagagctgagcccagtaccaaaatacggcaggctgctggggtggttggagtggctgtgcaaaggaggtggggtaccccctggatctcggagaatggaaatgattcagagagaaggggagtatcagagaggcagggagcatagcctgagcaaaggctatgaggtaggaaggaatctcacctgtagagggccccaccacactccctcccctccctgcacgcaccggcttttataactgttcagagcgttgaggagatgtggtcctcgatctgtcactggggtgctggtgagctgtgggagagcaggccagcaggacatcagacccaggcatatggcgcatggggaggcccaagcccctactccctcccttccatctcctgatgcttctgagtccttcaggtgaggaccactgactcactccaggatctcagaaaagccttttcacctctccaagttcattcccatttgtaaatggagagaatacttcctgacctaactgtattgagagctttaaaaagtccatacccttgacccagtaatgctactccatg

SEQ ID NO: 88 - DNA, 49080 bp, Homo sapiens
aggctggagtgcagtggcttaatctccgctcactgcaacctccgcctcctgggttcaagcgattctcctgcctcagcctcccgagtagctgggactacaggtgcgtgccaccacgcccggctaatttttgtatttttagtagagatggggtttcaccatgttggccatgctggtcttaaactcctgacctcaggtgatccacctgcctcggcctcccaaaatgctgggattacaggcatgagccactacacccagcagacgtgcatgtatctttatggtagaacgatttatattcctttgggcatatacccagtagtgggattcctgggttgaatggcagttctggtttttaagctctttgaagaatcaccacactgctttccacaatggttgaactaatttacactcccaccaacagtgtatatgtgttcccttttctctacctctccaaagttcattcttttttttctttgatacgacaaagtctcactgtgttgcccaggcaagagtgcagtggcgtgatctcggctcactgtaacctctgcctcccaggttcaagctattctcctgactcagcctcccaagtaacgaggattacaggcacctgctaccatgcccagctaatttttttttcgtatttttagtagagacggagtttcaccatgttagccaggctggtgtcaaactcctgacctcaggtgatccacctgcctctgtctcccaaagtgttgggattataggcgtaagccaccaggcccggtcaaaaaaaaatttttttttttttttttttttttttgagacagagtcctgctctgtctcccaggctgcagtgcagtagcataatcatggctcactgcaacatatgccttcttggctcaagcaattctcccaccttagcctcccaaatggctgggactatgggcgcatgccaccacgtctggctaatttttgtattttctgtagagatggggtttcaccctcttacccaggctggtgtcaaactcctgggctcaagcaatccaccagcctcagactcctagagtcctgagattacaggcctgagtcactgcacctggccatgttattttttgactttttaatagctattctgactggtgtgagatggtatctcactgtggttttgatttgcatttctctaatgatcagttattgagcttttttaaatatgctttctttggacacacacatgtcttcttttgaaaagtgttcatgtcctttgcccactttttaatggtttttttttcttgtagacttgcttaggatccttacagatgctgaatattagacctttgtcagatacatagtttgcaaatattttctcccattctgtagattgtctatttactctgttgacagttccttctgctgcctactgatgtcttagcatgacatgccctatgataactggaaataaagtagaaggcaagtacagtattagaacacatttaggctgggtgcggtggctcactcctgtaatcccagcactttgtgaggctgaggtgggcggatcacctgaggtcaggagtttgagaccaccctggccaacatggtgaaaccccatctctactaaaaataacaattagctgggcatggtggtgtgcgcctgtaatcccagctacctaggaggctgaggcagaattgcttgaacctgggaggcagaggtcacgccactgcactccagcctgggcgacaagaacaaaactcagtctcagaatgtgcagtaaccttaagtgcaagaaagtccttggtataattaaacgtcttctacagcaacggaatctggctctcattactagctgcaactcccaaattttccactaggtggcagaacaggctagataatagccgggggttctcaaccttagtgggcatcacaaacacctgtgggtcttcagccccaaagtttgattcattaggtctgggtgtggcctgataattagcattcctaacaagcttccaggtgatgctgatgtttccaggtgatgctggaaggaaagtacattttgtgaacactggattacagaaaatcaatgtagaccaacccaaggcccattcacccatccatccatccatccatccttcctccagtttactttgtagttctaggtgatgtgagcacagagaagaatgagacatggtttgttctcaagacatagtcgggtgagggagaaaaggaaaatgaaaaaaataactcttagtctattatttccacctctccatttcttccaatatacagacttcctaagtgttgtttttctcttcttctgtcaaatagagtttaagccttgtgcccttaaagcctgaaagatcaactagcccaagagctgccttacatggctaaacctgctgaactaagaaactcaggaatgtttgctatcctataaaaagtttcagatagaaaatctcctctctgaacttagaagctggagatataaaagcacacctgacaccctcgagtctgcattgagtaaaaataaaacacaggattactatgttcttagaatctgtgcttggctgctttccaaaatgaattcctcattttaaacttcaatatatattatggttaatttggggaaaaaacattttgactcatgactgtccatattttcctttaaatagtattgttgactagctctaatctttggtactgggtcttactagatctactttttgcataatttgtgatgtaccatataaaccagtaatatgtaaacagattgtgtataggtttacttgacacaaatcctttttatgtaatgaaagaacacttcaacgcatgtcttgggttgaactattatttctaaatcagtgataattagattagtgaaattttatttatagccataattcatctcgaccaatgatttcacaagtatttgaaagtgtaatgggtaaaagatgcagacagaattcaagagatacaaataagcacacataaaaatatgtcattttctctctagtcccctcccccataaaaatgttgtcatgtgttaaagaaatgtcagttaaagcaaccttgagatacttcctttatatctattaaattggcaaacatgtttagaaatgttctttcttgactcgggcagtggttagacaagtgttcacttcataactattcgacaaaactgtgtgttgtatgcactcttctgtacctgtaacagaaaatactaagaaaaaattccactgcttttgcgagtaagtcttctactggaacttgttctaaggaaatatgcacaaagaagttctctgtagtatcttctaaaaagcagaactggaaactacctaattatctaccaaaacagaaatggtttagcaaattacagtaatgaaggaaaattacaaaatattatggtagttgtaaaaacctaaagcacatttttgagaatgtattacaaaacaatgatttgcagtacataaatccatacacatgtgcataaggattagaagagagtattaaaaatcgtaatgataaaggagctctgggtaattttctccataagtttttattactgttagattatctttaccacagagagcacagaacatgtggttaaaatgcaaaggacaggaacatcccactggcagggactactcatgtctaatcacagtgtgatcattaaatattctctccaaatgtactcagaacacttcagatgtttacaggatatggcagaagagggacgtctaagagaggaaaagctgtgtggaattgatctttcatttgcttctgatcttttattttcaattttagatgctctggaagttatttttcttccaagtttagatagctcttaagacaatccatggaattcattaaaatctcaatgaattcctactctcaatcttacaatgttgctggggaaaccaggtattcacttgtattttggaaaaaactgagaatcaaggatgaaagttaatagttgtctactgcaaaaggtacaacagtatttattgctaaatgaactgcaccactaaccttacacaaaaatgctcagtgaggctggagtggggtatggtggtcagcagaggctttaaagatagtgggagatcaatgggattaaagcctggccctaggactggtggaaaggaacatcaagaactttccacgaggatgggagattaacacccaaagcgcaagggtggaaataaatagaggagcaagaactgtttgctcgaagaaattagctagggctccatgatgttaaggaatccagatgtgccctgatggtaacggagagttaccaagattgaacaagagcaagtaagtgctcaaagaagtggttggggagactccctggaagcaaagcataagacaggttgaacagtgcacacaagtggtgaaggcagaaggcagcagtcgggatttgaagagacttgaaatacagaaagaacagacaaacatgaaaacatggaaaaaatccaggtgtgtgggggctgaaaatcagggcttcagcctcaccacttactataactcctctaggcaatgaatcactttaccaagccacagctttctcatctgtaaaacaggaatgacaatctgcccttaatgatgctgtcaggggatcaaaggtgcagggccgtggtactcaaatgacaagaagccccgtaagtttaagttagtaagaaagaactcatgcaaagatgtgctggatagacacatccttgggcaaaagagaggaagactattccaaggtctggaagcaaaatgggacttttacccaccccatcccttcatttgcaactattcatgaaattcaccaaaattatttccttgtgttttacctttattgttttgctttttggatcaccttcagaaatggttatattgttgagtttaccttctagaagatgcagaaacagtaaaaaaacagagccacctcagatcactcaaggggttgttctattttcaaaaacacactgacttttgaaaagtccctgcattggttggataaaatgtctgaagtggttggggggaaagcaagacaaagtcttaactacagaatatatttttaaggaaatgcagctttattactttcaagtacaaacaataacttgggcttggctaaccaaatttgcctaattgagggaatctgctttaatgtacagatataaatgatttatagttaacacaatcactcacgggtaaaaagagtgcttctatgatgcaagaaaataacttctcatcttagagacatcttgttccacaatcaccccactatttgcttaagcaacctcttcttccccctaccccacacagttcaaatataaactttatctcatgccctctaaatcacaacatacatcaaattcgtgaaatatgagttgattactttttccacattgctatagatgttggattgctgacagaactatctcttcaacctgagcattctcatcaagtatactaagtctaaatcagtgaaatatgcctgttcacaatctgagtacaaagacaccaaaacatgagcttttatcatctgaattactaattttccagggttgaatattaaaaacacatatttacttgggcacatttatgaagagtagaagtagctgaattctttaggctgcaataattaagtgggtttacactggtcaggattgaattactaaatttaaacaactgaactgttccaggaaagacaagaaacactgaaacatcctaacagcaaaacagctttttgcactgagcgtgaccattcagtctgattaggctgatgggaatggtgcaaagactactcagtaatccatttgaggatttattctgaaaaaagtttactttcctagagcaggcatggggaacctttgatcagaaacactgccaaagatggctaatgggcattgtgtcaaaaaagtgaatctgttcttttcatcagacattctgaggacagcataattctcaagtgtcttggttgtctaaaccaagcgaaagcaccagcgtaaccaggtaggagggctgtgtcaagaagacggacctaaagggcttctcccctatcctgacaactgtgtccacaggcaaaggtgacagtatgccctgcccggactgcatcatgagtagcaatctgattctgctcgcttcccaacagagaaaggcaagtggcttcatacaccaaggcccagaggaagaggcacagaaagctataaaagtgatgctggggccgggcacagcagctcacgcctgtaatcccggcactttgggaggtagaggcgggcagaacacgaggtcaagaaatcaagaccatcctggccaacatagtgaaacctcgtctctactaaaaatacaaaaatagctgggcgtggtggcacgcgcctgtagtctcagctactcaggaggctgaggcaggagaatcgcttgaacccaggaggctgaggttgcagtaagccgagatcacgccactgcactccagcctggggatagagcaagactctgtctcaaaaacatacaaaaaaaacaaaacaaaacaaaaaaaacagtgatgttggtaggattcacctctaggcaatctggaagccacacagtaacaacttcaagttgccagctgggtttggtcaaagaaatgtgtaaagccaggatccactatccttagctgattctgttagatcaaaatgcctaatacaaacaatttcctcatgtctaaaatactgtttccgaaagttatttcttttgttttacaaatagagagcagtaatcattttcctatgaatactagaatgattatataatcctcattcaaacctcacaccaagtgttttcaacagccagaacagagcaatttttaaactacgaaaaatgaagtgcaaaccttacaatttcatagcaatgttccccacgtttcactcatgaacagctatccaattgcatgcaccttcctgcagaacttcttccaagtccagtccttccactggaggggctttcttcctatttctccaataggtctaaaatgtcaggttacagtcagatttggcaatgtgtattacttcaaatgattgagctggaggaaactacattcctttggaatgatgacagaatctatcagaaacttcacacatccactcagctctcctggatccctgtccacaccatgaagcctgaagttgttatgatggcctttatgaacctgaaagaagccgctggcttccaccacaccacagtgtcacccaagaaatccaatccttgtaagaaaggatagggcttatcttctcatgacttagaatttttcagaaatgagaatattcacaaaagagggaaaggcaattcccttacctatgcgctaaggaagccaaagtcagtgtgtgcaagagctagctctcaaaggcaatgaaaggagagtaaagaatagttttagttatcccctatccacttctcattctgactccccactttgctttcttttgcaaaaaggatgagctagttttccatttttataaaaactggcgatagtatgaataaacccagcatctataaagtagttgaataaaatctcaggccaaataaaggcctccataaggaagaactgacattaggactccaattactgcctgaagttctgctgtcaaaatccagctgcatgatgatgccactgtactccagcctgtatgacagagcaagactgcctaggaaaaaaaaaaaattccagcggcaccaagtaccaccttgatgacttctgtattcaccactaaaaactgaaatagaacatactatatacagcttcaagtttgtcactttttaataaaacttttcccacaaatgattataattacttgccctttgaagctattggatagatctgaaagtgaggtagggtggggatggtcattagatcagtaatagttatctgttcaggctcgataaaaagtaaaaactcggccaggcgtggtggctcacgcctgtaatcccagcactttgggaggccaaggcaggtggatgacctgaggtcaggagttcaagaccagcctggccaacatggtggaaccctgtctctactaaaaatataaaaattagttgggtgtcatggcagatgcttgtaatcccagctacttaggaggctgaggcaggagaatcacttgaacccaggaggcggaggttgcagtgagccaagatcgtgccattgcactccagcctgcgcagtaagagcgaaactctgtctcaaaaaaaaaaaaataataataaagtaaaaagtcatttaccatcatcattgcccaaagtctcctggggcttctgcaaaatagattcagttgtgattccggttctatttctagagtactaagcagagctgatgcacagaactcaatgtgagatagattaaacccagattttgtgggatgggggaagatattgttcttttgcttaaaccccacagagtttcaacatggatattaatgatatctgtccttgaaattcaccattaatttctatcaacttcacagcactcagaggtccagagtctggctctatgctaatgcagattctgcaagagataggtccccactctagagttcacatcattctcagctctgccagcaaccctttttctcacctgtaaaatggatatgctttatactggagtcagcaagaaggaataactcatgttcccagacataagctgtcactgaggttccaattcttatgttcatcttcaaactaccttcctattggtctgtgaatgaaatacatccctccccaccacccttgtaatacaaggggagacagctgaagagcggctgagatttttctactgcttgctccctctactctctccctgattgtgaccactaacatttccactgctgaatcacaaaattacctaactttagagagggaggaggacacaatctggcaacccagggacatgttttgtttggctcaccttatttcaaattttctttaatcagttgtaacgttttaaaaatccaggatttcaaataaaaatctggatttctagctcctcctgaaacaatgtgaagacctgccaaccctgggcttgcttctcctaatgacaaaacagagctgaataactgccctattagatcaactttccaggggacagcacaatcctccccagaatgttttactcatttatgttacctgcacggctcccttaggcatttgggtttgtgagccctcatctaggacaattccctcacttaaaagatgaagaaaatgatggtcttagaagagaaagttaacttgcctgaggctgcagattaagttagaggcaaaggaggaagttaggttgggttcaggtatccttctagtatagcatactgtgtccctatttaaaccatggcttctatcagcatttcttcaaccaattacttaaactgtctaagtggaatcagctatattttctacatttcccttttattcatccttttcatataattgatgttcttatagaaaactctgtaacagtcatttcatttaaatattatccgacctgaaagaaaccatgaatcagggatcagacaaaaatacatgatcaacttttacacatttcagtaggtgaaggaccagaaagaatcttagaaatcactgagcttcatacctggctgtacagacaaggaagctgggacccagagagggtgcagagttccagggtaagaggcccggtctctaaccttccagctcactgctcttttctgctataccagggcaccgctgtgcagtcatccaggctgccggggactagcttccccgacatggcaacaaaaactacagaactcgctcacatcttaaacatggccaaccttgactctgccaagatataaggtttagaatgagttgctaacattcaatttacagaattggatttgaactggaagacagactttccttagcactggtatttggtggaagtttataaactggtatttggtggaagttttaacactggctcttataagagctaaaccccgtgtgaggaaagttgctgtaacaacatcatagcacctttgcttcaacttcaaaagaaaaaaaggctatggtaaaaagctttaataacagacaatgtgatttcataggcaaccaattagcagattaatggatcatttaactttctttacttaaaaccaatactccactcaagaaagatgaacccaaaatgcatcctctaacactgaccaacataactaagtacaaatgaagtcaatggtgtaccccattagcatgctgcgttgtatgtcaataaaacaagccctcccccaccccgagccctggcccctggcaaaacatagataaatgattgtgcactgcgtgatgataccattaggtgagaactttggttcatgcagtcggctgccgcagaggttgcacccaaaacccgcagccccggcacccaaagtcagtcagcggtggtggctcatggtgtcagccgtgctccttccacaacaccaggtgaatactgtggtcaggcatgctggtggcaaagaccaagcccgtgtcattgtgcccatccagtccattcagccaggatgcttcgcctgccaggaagcttgagcctctctttgatttcctgtactctggcagaggccagcgactaatcaggctctctgtccgcaagtccatgatgtacaggtagcggttgtcaaacagcagggcaaagatatctccaaagccaagcaaggccaagtttgctatctcaggagtcttgatgaccctacaaggatgagagttagggactgtgaaagaaggcaaccttgcttctgtttatgctactgtaatcttttctggagatatttaaaaccaatattaaattcaagcaaatttagagttaaatgtttttgataaaaagtaaaatataaggagaaaagctcagcccacttataaaaaagccgggagcgggagaggtgcgttcagtcattatataatattggcatggaagggaaaggtggtgtttgatcaaagtttttttttttttttttgagacagggtctcactgtgttgcccacactggagtacaggggcgtgatctcggctcactgcatcctccacctcccaggttcaagtgattctcctgcttcagcctcacaagtagctgggactacagacggctgccactgcacctggctaatttttgtatttttagtagagacgaggtttcaccatgttggccaggctggtctcgaactactgacctcagatgatctgcccacctcggcctcccaaagtgctgggattacaggcgtgagccaccgcacccggcctgatgaaagtttataaaagtacaaaacatctatccaggctagaaaggatcttacagataacatttaactaaacaatctatttttaagctgtgaaaaccaaagctcaggcagagtaaatgctttggctaaggattcacaatttgtcagttaccagtgagaactagaaggcaagagttaactcttaccactaggtaaaaagatgtattcatcaactcctagaatactggaacaccctgaagcccagaagaaacctgaaagccaagtgactaaagtgctactctactcagcaggcagcaaacaaatgggtttctctctaaaaacagtaaaggctgaaaatatttaaagtttcccaaataacttagaaacatttattaataatagattcataaaaagttattatgaaaaaaactagggaagaaacaactaggggaagcagagaaaagtagggagttgggaggacagccctaactttctcagaggcagtttccaagacatcaatgacaaaggctaggagacacctagctaaacagcagcacaaaggaaaacaaaaaacaacttagcttctgttgtctgcgcccttagtgaagcaaaagattaacaagaaaagctgatgtcctctttggaggaactaagagctgagctaccagacaagcagtagacaaatactgctctgtgacatatggtggggctcctgtgggaggagagtttagcctaggttttaaggacaccaccaaactagtataggttcaagagagcaaccagaatgggaggacctggagaccaggacaaggaagaacagctgaaggctatcagctgagatggggaaggaaagagttggcaggcatagggtaactgtatatgaggatcacttctgaatagtgaaagatgtgtaagagacagcccagacattataagctttagaagacagaactaggatcagaggcaaagagttacaaaggagccaatttcagtctcatatcaggaaggatgggggacattcaatatttatcaagcatttacatgtgcaaggcaccgaacttcataattaacatgttatcttttttaattatttttatttatttatttattgagatggagtctcgctctgtcaccaggctggagtgcagtggcgtgatctcggctcactgcaacttccacctcccggattcaagcgattctcgtgcctcagcctcccgagtagctgggattacagatgcccgccaccacgcccagctaatttttgtatttttagtagagatgaggttttaccatgttggcgagatggtctcgatctcaaccttgtgttccacccgcctcagcctcccaaagtgctgggattacaggcgtgagccactgcacccagcgtgttatctcaatcctcataatgcagttaggtagaggtattctctccactatatcagtaaacaagactaaaacatcttgccatgagtcatacagctaacataatgcaggcctagcaaatgttttctgagtatcataggtgctgagtgctggctgggcccctgaagagagataagcaagatagtctttgccccttagaaggggagggcatagcatataactgccagagtatgtgagaacatgctcagcacaaacactccaatggatataacaggagtatcaaggagtgagcaaatctttctgtcttttatagctggacctggaagaatattttttctctttcttgaagaagaaatgcaactgggcaatatagatagaatacggaaagcctgtctaaattttacaaattctctctcatgggcatgtgtttctcttataattaatatctgaaaaaaaaatctatgatactaagaatatcaacaagacatcacttctatgaaactaagaaaatagttaacaggtgctggcccctgcttgaaaagcagagagtaagctcaccttcccagactgaaaatggaagaaacttctgctaaaagaggtagacatttagattagatgacatgtttgagaacatccaaaatcaatcactgaacactccctatggtgtcagcctttataaacaggtttacaagatggagtctgatcccagggaaagcagtaagttcagattaacttcaagtaaaggggaatcagaggtcccaatatgtgtgttccaaatgagttataactgataactcatccatcattttctacttagatgactcatattcattcactcaacaaatatttactaagagcctaaagtgagctagccaatgttggtaccaggatttcggcagtgaataagacaaagttcctcacactcaaactatccaatactgaatttcctagtcaaacctgttttttctatttctttacttgctcattcacccaggtgctcaagctaggaaacgtggcaaccatccaattctcctcctcctcctcattcaaatcacaaattcgatcaccaagctctattgattttatgccctaaatttttctctaatttgttcactaatatatgcactaccacagctctagtccaagacaccatcttttgcctgcactattgccaacagctttctactgacctccccacatctacttagtccctttgaatcagttaacctcacatacaacctgatgttatcaccttgtttcaacttctaaactctttgatggctccttattgtgcccccatctttagccatgctgatgcatttaaggaatttccttcaatttctcaaatgtacctgaggctcctttaacctcagggccttcgaacggactagtgtctcagtctaaaattcctcactgtacacccactcctggtacttagttaaggcatttatactcaccctttagagctcagcccaaatgtctcctcttagaagccttcccttactccacaaactaggcagggcctcaaagtactctgtactaggctaggctcctcttaacccaaccattaaacaacctgtttgcaattagctgtttaacatcagtcttccccatcctgctgatcggtaatttccctgagtttggtaagtacttctgctgtttcccaatgcataccacaatgcctgacacaaaggtgggtgctcaatgaatatctaaagaataaagtagtggtgaaataaacaaaggcaagtgcaaattcctacaaaagagatctaaaggaggctaggaagccgggtgcggtggctcatgcctataatcccagcactttgggaggcgggtggatcacttgaggtcaggagtttgagaccagcctggccaacaggatgaaaccccatcgctactaaaaatacacaaaattagctgggcatcatggcaggtgcctttaattccagctactcgggaggctgaggcaggagaatcgcttgaacctgggaggcagaggttgcagtgagccgagatcacaccactgcactagagcctgggtgacagagtgagactctgtctcaaaaaaacataaaataaaaacgaaaaaaaaagaggctaggaaaaacagctagaaagtctggtaggtcccacatcataacagaacacaaaaaataggtggctaccgggttagggctcaagatctgtgaagatgagctgattccaaagactgaaacacaaatatgttgcagaatagagcacaggtcttgacaggtttgtggctttcactttgatcactttagaaatggaaccagacatccctgctgtgcagagtctgggtccttgaacctaagtaaccttacatgctgtagagataacctaactcaagcaatcacatcatatctcagacttattgagtaacatgctgttatttgtgctttgcttcttttcaattagcttcaaagctaagtagccctacctggtcctagcaactgaagccagaggatttgtagtaggtttcaacagaggttggtttatctgtgtttgggaggaaaaaagcagacacaagacagactcttttcggagaaaaaatctgaacctggcaactcctacccgcaaacaatcttacaggtttattatttaaaactattattcaaacactaaaaactagcaactttcatctaggactctagagtctctatatgccactctgagtcacaagcatacatgagaaagcagatgtgggaccaaattaaaccctttagagatgctaagcattaaaacaactatgacatctctagcccaccttgcctttgcaccttcccacctaaaattttaattcaaaacaaaaacaatattgaactataaaagatgtgattttcccatggtgattacttgaatattttgctttacaaaatatcagattctttcaaaactttattttcccctgtttttggtgtccctggctttctagtaccataagtatatacctattggataatccagccatgcatgaatggacgaatgttggaatacagtgagaggtggaatgctgggcaaggcccctaccctgtctcagcttcagtttccctacctacaagaggaaaagcttaaacagatgttttctaggaaaggtttcagtcttttttctcaaagcataaatatcaatcatttctataactgattctgacagctctgaaacctaactggttagaaatgttggtctgattccaggaagacataaatggggttgtaactttgtgatcagagagatgtggcccaccaaagttttgtggttattgtgatcagatccacacgagctgacctcaaatagtcatgcataaaaacaatgaagaggccgggtgcggtggctcacgcatgtaatcccagcactttgggaggccgaggcgggtggatcacgaggtcaggagattgagtccatcctgcctagcacagtgaaaccccgtctctactaaaaatacaaaaaattagccgggcatggtggcgggcgcctgtagtcccagctactcgggaggctgggacaggagaatggtgtgaaccctggaggcggagcctgcagtgagcagagattgtgccactgcactccagcctgggcgacagagcgagactccatctcaaaaaaaaaaaaaaaaacaatgaagagaatgttcaattttctgtactcctccaagtcctgaaccatgctatgggacgctaactttttgagttgttattaataagtgtgtgcacaacaggtgtgaagtacagtaggttcaacaaattcaaacaggtttctttacatgggtcctctcagacttattattaataaagatctgccaggtggtatactaggtcctcatcacaagcatttcatttaatagtcactttatagatgatgaaattgagctacagaggagttaagaaacttatactaaatcacacagcccattagagatggcaccacatcttaaaccaaggtttgtctatcaccaaagttctcttaatgaccacatggcactggcttccatcagccccaaatatgctaacagatactgtccttctccaagaagagcctatggtatgcagtgaatcacaaaattatttgtctatggactgctgcttatttacttctttggagggaaaccctgcaaattttatttttctctaagtctctgtctttctactagtcaacagaaggtcacttgatccctagataccactaaagtttaccaagtttgtaaaacaatgcagaatttcaacagaatatgaaataggacttaaaatattagaacttatggagatctgaaagatcttttcatccatgcccctcattttccagaaaagcatgttaaatctgaaagaagtggctcatgactcacagtcaggcagcggacgttccagtacgtaactctttttcatttgcttacttcctctaaaatatttttcctgtctgagatgttcagtatatataaccctgtttacaagtgatacagtatacatttcctaaaagccagctactgactggtacatccaaacatttagtcttgtctttactactgaactgcagcaggctttcaaaggtaaagcgtgaggtcgaaggaaacattacctgagaatatcataactggcaaagtcccactggtagagaccaagtgctgaactacagacaatgtatttgccatcaaaatgaagtcttggctgcaggcagatacttctatcctcagagacagacaatgtctttaagcacttacagttgatttctctcccaattggccaaatctacagaaaaaagaaaatgaggaaagatgagagatcacatcactacagaaaagcttgtccttaaaatggtctgcatttgtgaagtcagatagaaagtgaagtatactggaaagaccccaggttttatagccaagaatcacaggttcaagtcttaattctcctgtgcaatcttgggtaaattatttaatctctcttaactccagctcctgcaatgaagataatgcctatcacacgggacagtataaaagatccaataatgggccaggcacggtggctcgcgcctgtaatcccagcactttgggaggcctaggcaggtggatcacctgaggtcaggagttcaagaccagcctggccaacatggtgaaaccctgtctctactaaaaatacaaaaattagccaggcgtgatagcacacgcctgtaatcccagctacttgggaggctgaagcacgagcatcacttgaacctgggaggcagaggttgcagtaagcaaagattctaccactgcactccagcctgggtgacagagtgagaccctgtctcagaaaaaaaaaaaaaaaaaaaaaaagagatgcagtaagaatgtgagagtactttgtgaactctttgcaattcattacaataaatatttatgttttcatagttcagatctaagaattaaggacggtaggagatatgtaaaaaagtattaagaatgggccgggcgtggtggctcatgcctgtaattccagcattttgggaggtcaaggcaggcggatcacaaggtcaggagttcgagaccagcctggccaatatggtgaactcccatctctactaaaaatacaaaaattagctgggcctggtagcaggcgcctgtagtcccagctactcggtaggctgaggcaggagaatcacttgaacccagggggcggaggttgcagtgagccaatattgtgccactgcactccaacctgggcaacagagcgagactgtctcaaaaaaaaaccaacaacaaaaattaagaataagctgaacataaatttatgtgaatttctttttcatttacaaatccaagttaagaaactacacaggacatagagctagcaaatcatctcttcttccggtgggtttaaaatggcttggactaagacactccccctcctcttcctagaatgttcaccctttgccataccactttcattttcttatgttttccagtttttctttaatgaagcaaattaatggagaaaaaaactcaccttaatctcatatttgtctgcacttaagaggatgtagtctccaggactgtgcaagagagacttgactttgcacttctgcaaaactacctgcaaatgtaaaccatgttacggaaagatccttttaatgctgctcctataatgattttattctttaaattaaaatacaaaaatgagcttaacatatgctagaatagctaagccataactccattaccaaattaacctctactaaaagttttactacaatattctctgttattagcagtatctaaaagtgtctaacgttagccagatgaggtgggtcacgcctataatcccagtgactcggaaggctgaggtgggaggattgcttgagcccaggagttggaggatgcagtgagctatgattgcaccactgcactccaacctgggcaacagagcaagaccacaacgcttaaaaaaaaaaaaaaacagtctaaacattggcagcatttaatcttagcattcgtctagaagcaaacattaggactgattttttaaaattataaaatgtaacttaagagagggaacagaaaagaaaaaagcccgtagacactgacgtagatgcaaatgatctgctttcataactatgtgaatcataaatgaaaaagcactggacttgggaccagaatctgccatatgctgactttgcaaccttggacaagaccatctaaactcggtcagtttcttgatctttaaaacaggagacaagcacctattatcttacctcatttaattacagtaaagataaagtaacaatgtaaattatagtagtaacaaaataaaagctaacattctgttagcacttgagataagtatataaacatcaggttctagctatttttgcaatcaatcaggctaaggtgagaggggaagcagggttcactcattcagaagtctggattgcagactcaactgaaacagacctattactaagtatcaggcaccttgctgggtgctgtcccaacatttcatttcgtgttcacaggaacatttagcagatgacacagctcaggtcctgaaggtggagtaacttgtccaagacatcaccgtcagtgtcctagccccaatcaactattttccacaacaccaaactgccttacactatatagcttttccatgtaaaaagttaacatgggctaggcacagtggctcatgcctataatcccagcactttgagaggccgaggagggaggactgcttgaggccaggagttcaagaccagcctgggcaacacagcaagacccccatctccacacacaaaaaattttttttaattagcagctgggcacggtggctcacgcctgtaatctcagcattttgggaggccgaggtgggtggatcacctgaggtcaggagttcgagaccagcctggccaacacaatgaaactccgtctctactaaaaacacaaaaaattagccaggcatggtggtgggcgcctgtaatcccagctactctggaggctgaagcaggagaatcacttgaacccggcagatggatgctgcagtgagccgagatcgtgccactgcactccagcctgcgcaacaagagtgaaactccatctcaaaaaaaaaaaaaaaaaaaaagaaattagctcagtgtggtggcacgtggctgtagtgctagctactcgggaggctgaggtgagaggatcacttaagcctggggattcaaagttgcagagagctatgatcatgacacggcattccagcctgggcaacagaatgagaccctgtctgtattaaaacaacaacaaatgattcttctttgtttcccacagtgaatctgcaagccaggtggctttaccttaaagacatatcctttatgggtgcccttttcattattgccaggaaaatctaagttatgggcatcttttgcttagattactgccaaagcctaaatggtcaccctgtatccacttgtgcccaactctagtccattcttcattcagcagttaattttcctaaaacatagatcgcaccagacacttgctcagaactcgtggattgcttcctagtacacttctgatgatatccaccatacttactgtggccttataaatcatacaggattaccacctctctgcccatcttcccaactacagcatggctccactggcttatgtccaggtcatcaaatgttccaagttctttccacccgctgggcccgtgcatgtattgcaccctctgaaacaatctttcagctactctttccacagctatctcctatttattcttcatgtttaacccccttctcaaaaacttttttctgaactaattactttcctatacttttttttttttttgaaagagtctcactttgttgcctagggtggagtgcagtggcacgatcttggctcactgcaacctccgcctccccagcttcaagttaattcccctgtctcagcctcctgagtagctgggattacgcctggctgatttttgtactttcagtagcgacggagtttcaccatgttggccaggctggcctcgaactcctgggctcaggtgatccgcccgccttggcctcccaaagtgctgggattacacatgtaagcctctgtgcctggccctagactgtcttatagaacactgtactgttccttcacaaaacttaacacaatttgaaatgatatatttacccatgaaattgtttaataaaactatttctcctattagactatcatccacagggtaaggactgggtctattttgcttactcctgttttctcagccccctcatagaatgggatggtaaactcaagaaaagtgcttctgcgtggtatatccattattaatactgcatttgatcctcacaacaatcttgttttttttaaaaaagaaaacattacaatattttactaaagatcctgtacagttttctttgtcctacttcttgtaagcgttattttttcaaaatgaaaattgcttttctgattaagaaagaaacatgtttattctaaagggaaaaacacgcccacaatcccaccagaaatacccaccttcaacattttgatgcatgaacacattcagaaaccggtatcacactctacatatttttttgtatgtaatctgttttatttgccccctctatccacctaatatattgtgggcaactttccatgtccataagtcatttatttgttaaaccatgtattaagtaccttctacttgctggtcactgttgtgtaccattatgctttgtaggtacagcaattccatcttatgactcacctaacacttataaggcagtgtctaccatcctccacgccctccctcaaaaagcctgataagcaggagacttcttccaagtcttcctaccttggtgacccattccgtgtgcccggtgagtgtgttcaggcatgtcccagcagataaagcccatactttcacagtgaagtctgcagagccgctcaccaagatatccagttcatcattgtagtccacgctaaatactagtgcatataattacacaaagttaaaacatgtctctgtcagtgggtcttttataatagagttcaataatgtttattttccccaattatataatttcccaaccagagacaccgtaagaatgatgctattcaactagcaattttctgataaaactatttcaaaattcttactattatagcttattattctaaggtggaaagtcctaggaataatacaatctcttttatttgtggtagctacagtgagaggcaaaacaaatgttggagataatggcattccttcttaggactgcctgcctgacactacacaatactttatctaatttatgcaggaaaacaaaacgtacatggtcctactctgatacacactaacagtaagacaaaatataaagaatggaagctgcaaaacagcacccagactcaagaaaacccaatgtaaagagagaaaaaacaaaacaaaaacaaggatctcaaaggttagattaagccattaactcaaaagtgtctgaatttcttcacagctgtatccccagcgccaaaaacagtgtaagctgtatagtgtgtactcaaatatttgttttcaaatgtataccagttctaaaggaacattagggacccagagatgaagacactgattcttcctttaaggaactcaatctaagtagggagtggaggaggaagcccagaaaaaaataaatgtttacctcttgctagggaaacatcaaggagaatgactaactctgcccaggggtatcagggaggacttcagggaagaggcgatattggagatgggccctaaaggatgagcagagtttatcaaggaaagaaaaaagaatactgcaagcagagggaatagtaaaggtatgaagttaagaaaaacctcagcaatgtctaggcaacagtaataaaaatttttagagcagggttctcaaagttgatcaggaataaaatcacctggaagtcatggtacatcttaacattgtggaacataacactcaatttaacatatacttccatgcatacatgcaccttcaaatattaatttctaacaagtggtagcagacagcaaagactgaagaagagtatataggaggacaaataaaatgaagcaaaaaatacgtgtttttattagcctaacggctagttttacttcaaagaatcactaagcaccaggtacagtgcaagtaactccagtcacatgggtgaacaagacagataagatcactgtccttatggagtttagtctggtggggaagcaagattatatttgtatgatgagcggtctacagtaatacaagttactgggaaatagagggacgcaacctgttaagggagttttggaaggctgctcataaacgtaatgcttgacattacagactatgattctcagaggctaaagcagtgggtaaatgggggaaaggaagggagctgctcaacacaagaggctgggaaatagctcaatttctacacaaagcctccccacccccgcccccgccaaaaaaaaagcaacagagagagaagctcaaatctcaaggctatattcaaatgaccagtttttgcaaaataaggatgctatacatttattaggaaacattcaggtatgtttctttcgccttatctctaggtggtagcttgttttaatcaactgtcaaccaagctcaaactggatgtaatctgtgtagaccacacaatctaagaaccaccgtcacaccaaagaactttcagccctaatgctacaaataaagtggaatttacacaagtaggatttactcagttcagaggtatggaatctgataaaagccaagggactgtctgttcaataggatataaatgaaacaggaggggggagagagagaatgagagagagagagagaaacagagagagaatgaaaactacccttcccaccagaagggtacacacatagaagaaagcaagaaaaagcaaaactgggtaaaacattcgaaataagagtaactagaataaagggaaataactgcaatgactaagaaagagggttgaaaaaagcaggttaaattaaaaaaaaaaaagcatttcacattcttggctcctggcttaaaaggatgaggctaagttgtaaaaacccttgaaaaagggcaacccacccgcccccgtgtgcccccgaaagtgctgggtcctggctccggaactccattcccagcaagccacagtgttgtcaaaggagcctgtcacaagcttctgttcatcaaacttcaccgctgcacaagtgtgggtctggatgccataaacgcactgccctgtgctcacatcccacagctttgcagacaagtcatctgacccttcaagagaaaaacagggaggttaataagaaaacaaacacactaaagaaggaaaatcaatcccaaaatcatggtgttcttcaagaacattaacggtcccttcctctagcactttactttaccactgaagaaatcaaagcacggagagagtaacacaacttgcttagagtcaccaaaacggagtcaaaagcactaggacagaatccaagctttttgggtgagacactttcccttaacttttcaggctacagaaggtcattagactaaaagcatcccttggtgcttccacttgaaaaatttcataaatccttggctatcacgagctctctgatttgacttcaaataaataggtattacacatgactgcatgtttacacttgcatgcttgtccattacccaacagttctgaacaaataaggattgttaaatagtaaaggtgtttgctgaaatatattccactctaaggcaagtcaaggacaaacctcagagcctgggctaacttctgcaaaagctaactgctaattgctccagtcatcttgaaatacgtgaaggaagaaacctcaaggaaaacctgggataaattatccccagatattcacaactcaacaaaaagtttgtaaagcctcttaagattctgaagggaaaagttggctttatttctgcctctgatgaaaattctatactaatcatggtgacaattcaggactttgctttaagtttaaaatcctaatgattaattcattcttacaatgacccttcaataagcctcaacaaataaaaagacatttttgagaatccactaaatacagtcactatgataatggcacagtatcctaggaaagcaccaaatgaccagtttttaaaaagctgaaatgactaaagccagccacaattctaccttcagtcaagaaccactgtttgagacaatggaaaaatagccatcacttatgaaagagctagagtatgaattttaacctgggaaaactatgatagcatactgaaataaagactgtatttattgtcactttgctatttagactgtttccttctgtataaaaagaggggtaggacttggttggttctcaatggccatgtgatacaactttatcaaaacacacaggcaggtccctattttcagagagtttaacttggggaacatctgaggcagggtccaataatcttaaaagtttgccaggtgattctaactcatcagcaatattttgagagccaatggtctagaacggtgctatccaacagaaaatataatgcaaactgcagatataatttaaaatgtcctaatagttacattaaaaaagaaatgttgggccgggcgcagtggctcatgcctgtaatctcagcactttaggaggccaaggcaggcatattgcctgagctcaggagttcaagaccatcgcgaaaccctgtctctactaaaataaaaaaaatcagccgggcatgatggcgcgcctatattcccagctactcggaaggctgaggcatgagaatcgcttgagctggggaggcagaggttgcaatgagctgagatcacgccactgcattccagcttggactacagagggcctccacctcaaagaaaaaaaaaaaaaaaagaaatgttagccaacatggtgaaaccctgtctccactaaaaaaaatacaaaaattagccaggcatgatggcgtacgcctgtagtcccagctactcaggaggctgaggcaggagaatcacttgaacccgggaggaggttgtagtgagccaagatcacaccactgcactccagcctgggcaacagaggaagactctgtttcaaaaaaaaaaaaaaaagaaaatgtgttaaaataattaaatgtgtttaactcagtatgtcaaaaatgtcatttgaacatgtaatcaatacaaatattgagatattttatattcttttacattgtatgtctttgaaacccagtatttcacacctccatttggactagccacagctcaagtactcaaaaaccacatggcgctagtggctactgtaccggagagcgtaagcctagatagtctttaaggccttcagttcaggcatgttgtgactgtattcctaaggagctagagtaggaaaggaaatcattttaggtcctttatgagcttggttttggttaccagtgttcaactggggtctcattcattcattcaacatatatttatagaacttctgtgtcaggcaggattcttgttctcatggcactcagtctacttgggaagacaaaaaggctaaacaagcaataataattcagtatagtagctggcaggcactacaaaagcccatagcaaatacaaggagaggacaagaagagaaaacatctcagacgaggctccactgaatttatgaccatgctctataacacgtgccttaggaactggcatgattggttcttcaactacactcctcttttgtttttaagctgggctttggtataggactgtttcaagaaagaatatcatggcaaaaaaaaaaaaacctttaagttttaactaatttaaacctaaggatgaataagttagccaggccaaaacaaaacaaaaggaatagtatataccaaaactttttctgtaaagggcctgatagtaagtattttagacgttgacctattgagttgcaattactctcttctgctggatttggcccacagtccacagtttgccaatccctggtatatacctattaaagcaactattaaatatctctatatgcaacacaaaaattattgaaaaggaactgggatcaagtcataaagaactatttggaatcattcaaaaaaccgtctaggagttatttacaatgcttgtcaaaagcactgcctaaaacatgaacactgattatgaaaacagttcagtctgactgcgaaatagtggcaaggtttggctgcagaactgggttaggaggttgtttaactatgaccttatttgcatatcagaaagatcactatggctatatcatggaaaaaggtttgaaggggggaaaactagaggcaagaaggcagttaaaaaccaggggagaggacaaacaaaatgtgacacatacatggaatatattttatatacatacacacacacacacacacacacacacacacacacacacacatacacacacacacatatatacatacatggaatggagttattcagccttaaaaaggaataaaattggccgggtgtggtggctcacacctgtaatcccaacactttgggaggccgaggcgggaggatcacctgaggtcaggagtttgagacctgccttaccaacgtggagaaatcccatctctaataaaaatacaaaaattagccaggcgtggtggcgcacgcctgtaatcccagctacttgggaggctaagacagaagaattgcttgaacccgggaggcggaggttgcggtgagccaagatggcgccactgcactccagcctgggcaacaagtgcaaaactccgtctcaaaaaaaaaaaaaaaagaataaaattctgagatgttatgatatggaagaaccttgaagacatcatgctaagtgaactaagccagccacaaaagaacaaatactgtatgattccacttatattaggttcctagagtagtcaaattcatagaaagtagaatggtgggccaggcatggtggctcatgcctgtaatcccagaactttgggaggccgaggctggttcacctgaggtcaggagtttgagaccagcctggccaacacgttgaaaccccgtctgtactaaaaatacaaaaattagccagacacggtggcgcatgcctgtaatcccagctactcgggaggctgaggcaggataatcgcttgaacctgggaggtgaggttgcagtgagccaaaattgagccactgcactccagcctgggcaccaaattgagactctgtctcaaaaaaaaaaataaaacaagcaagcaagcagaatggttgttttgccacaggctgtgggggaaggggcatgggcaatgtttaactgacagggtttaggctggacatggtggctcatgcctgtaatcccaacacttcaggaagctgaggcaagaagagtgcttaagcccaggagttagagatcatcctgggaaacatggtgagaccccatctccataaaaaatacaaaaattagctgggcatggtggcacacacacgtagtcccagctacttgggaggccaaagtggaagaatcgcttgagtccaggaggtagaagttacagtgagccaagatcatgtcactgtactccaaccactccaacctgggctacagagtgagaccttatctcaaaagaaaacccccccaaaaacaaacaaaaaaattggatacagtttaactatatagtgtattatatactgtttatacagttaacactgtatagtgtttaactgataccattttagtttgggaagatgtaaagttctggaaatggatagtggtgatgactgcacaacaacgtaatgtacttaatggcactcaactgtatgctttaaaatgattaaaatggtaaattttatgttatgtatgttttcgcacaatttgcaaaaaaaaaggttatccaaactaattatttaaactagtttttataggaaaacattgtgccagttttacaccctaaaaaaaaataataataatcaggttgagtcgagttccatttatagtgatgcaagtctactcctgagaatcctttaggaatcactgttctctgctcctttctggctttatgtcagcctcccctctggactcccatttgctgcactggctaacccaacatgttttcaaagaggtcaccagtgatgcagcatagaggtgaaagaggactaaagaaatgtggactctcacactgcacgaaagaaaaaaatccctccccattcagtatcttaaaaatcttaataatactttaaaaaaaatcagactattgcacagaactctagatttcaggcttctcttgaagtcagatctaacaactctgaccctgaatcccacccacatggcaataatttattacaatggagcaccagctgcactctttagaaaggcaagtgttcttgatttgctatagtccacacagagacttttacctcagtcaggtcatcttcctggtcccagtgtgtatgttccacaagaaaaaactgctctaattcatccgtgtatgccctcacattgtttttcaaacagtaggcatcccataagtaaatatctactgaacagcacaaagcataatagattcctttcttaccatttcagaaataaattgcgaaagagaaagataactacctcaatgtcattagccattaatctcttcaataaaactgtctattgcttactcaaggcactaatgtgagagtcactaagtttattgccaaattcagggtttcccaattccaccacaatgagaattcaatctcttaagtaacaagatgacacaaacacatgtacaattctgtcacaaatacctctcttcacagttccagggatgctgctgttagaaaaattaaactaatactttggatcattttcaaccactgcacagcgtaattttaaatatgcaaacctgatgaatttaatcagaataaaaatcacattaacatacagacccaccaagagaataatcttaaaatgtagaattgtagatattaactttccaggtagttagagaattcagtgaatatttcccatttacttccactccaagtaactgcagtttttactacatttcaaaaataaggtttgatgagagaagaaaaaaactttttaaagcaagaggacctaggcatagtggctcacaccagtaatcctagcattttgggaggctgagacgggcggagtgcttgagcccaggagttcgagaccagcctgggcaacatggtgaaatcctgtctctacaaaaaatacaaaaaggatccaggcatagggttgctcgcttgtagtcccagctaaacccgggaggctgacatgggaggatcacctgagcccaggaggtggaggttgaagaaagccaagatcacatcattgcactccaggatggagctacccagtgagaggttgtctccaaaaaagaaaaaaaaaaaatgcggctgggtgcagtgcctcacacctgtaatcccagcactttgggaggccgaggcaggcagatcatctgagatcaggagtttgagaccagcctgaccaacatggtgaaaccccttctctactaaaaatacaaaaattagccgggctgtggtggcgcgtgcctgtaatgccagctactgaggaagctgaggcgagagaatcgcttgaacccaggaggaggaggttgcagtgagccgagactgcgccactgcactctagcccgggtgacagaggagctcctgtttcaaaaaaaaaaaaaaaaatgctacaggtggttgtgaaaaaatggtcaactgccagtaggagctccaagctccaagatgatactgcatcttaatattttttttttttttgagacagggttttgctgtgttgcccaggctggagtgcagtggcacaatcttagctcactgcaacctccacctcctgggctcaagcgatcctctcacctcagtctcccaagtagttgggaccacaggtgtgagccagcacacccagctgtttttttatttttttgtagagatgggattttgctatgttgcccaggctggtctcaaaactcctgggctcacataatctgcctgccttggcctcccaaagtgttgggactacaggcatgagccccctcatttggtcaactgcatcttaatcttttaaaatcatgaggcaaaagagacatggaaaagccatcaccacaacagagaaagtacatcaaagcctagaagaactggtgatgttgttctagtaatcaggcttgtaacacaaggaaaataaagtgtgaaataacttcaggatgacaaaccaaaccatgaaatgctttaaatcaaatgtttattttccaaaaccagcagagtgtctagcatttcagagaaaatatcaccacataatacatacccttaatgaataaagaaatgcattgtaaaacggtcttgagaaatgatacatctcaacattaaaaatatttaaattgagtctggtgagactcctgagggagaagcaagttacttaacactatattggtatggcatcaattcaatctatctggaaagggcactaagaagagctataaaattgggccgggcacggtggctcacgcctgtaatcccaacactttggagggtggatcacctgaggtcaggagtttgagaccagcctgggcaacaaggtgaaactccgcctctactaaaaatacaaaaaaaattagccgggtgtggtggcgcacacctgtaatcccagctactcgggaggctgaggcaggagactcgaaccctggaggcagaggttgcagtgagccgagattgcaccactgcactccaacctgggtgacagagtgagactccatctcaaaaaaaaaaaaaaaaaaaaaaaaagagctataaaataattcatacttctgtatctggtgattctacttttagacttctatcccaaatgaattcaagggaaaaagaggtaatacaaagacactaataaaaacagaaacaatctgaatatgcattgatatggttaagctttgtgtcctcacccaaacctcatcctgaactgtaatccccaggtattgagggacagacttggtgggaggtgactggatcatgggggtggccccccatgctgttctcatgatagtgagtgagttctctccagacctgatggttttataagggcctcttcctgcttcactcacactctctctctcctgctgccttgtgaacaaggtgcttgcttccccttcgccttccgccatgatcatattgccttctgacatgattgtaagtttcctgaggcctccccagccatgtggaactaggagtcaattaaacctcttttcttcataaattacccggtcttaggcagtttttttagcagtctgagaatggactaatatatgcattaatatggaaatggctaaataatgactattgatatatttacaaaaaggaacagtttataccgtaatacacaaatgtttattggaagttatcttggatgaaaaagaacaccaagtatttctatatattatatacaatgtaaggaaacaggcattgggattattagcaagaactgcctggagttattctaaatgctgcctaagaattatttacattgcctgtcaaaatgtattatctaacacatgggcattagttataatcatatacagaaacacacgtccattacaaatggaaaataacatataattttaaatttttaataattatattgtttcataaaattacttaattgcctagttaaaaaatatccagctctctctgttcccaggcccaaactccaacttctacttcttctacttagaatcacaggatttcagagcaaggaagaaatatctcctttcatatatacatatatatttattttgagatggagtctcactctgtcacccaggctggagtgcagtggcaccatctcagctcactggaacctccgcctcccgggttcaagcgattctcctgtttcagcctcccgagtagctgggattataggcgcatgccgccacgcccggctactttttcgtatttcagtagagacgggatttcaccatgttgaccagtctggtctcgaactcctgagctcaggcaatccacccgcctcggcttcccaaagtgctagaattacaggcatgagccactgcgcccgacctcctttcccatattttaaagatacagagaggttaagtaatttggccataatgatctaactacttgctaggattagataccaatttttccactgtttttttcctcaaatatcagtgccaacagaaaaagaaacagaatttagcaacagaggactacacatggaggaaacacaaagaaaaagtaatctatagctttgtaattcacataatgtttaaaagacagtctgaagtgtttttctcataaaattttataaaaatgattgtgttctctagagagaaggaagaggataaggggggggaaccactcaggattagagaaaaaaagtcactgtacatatctcatataatcaacacttgtcattctcaaagctcaagactggttcaagattacaccctatgaaatacaaaacaaaacccaaaaagcagtttcaacatctcttacctgtacagagaagtccatctttgtagtaaagtgcatacactctggcactgtgtccaattaatgacgaggtttcaaaggcttcatggtcctccagttgcttcattctcaaaatagccttcaaataaaccttcttccagtgcaaagcgtcctgaacagaatcatctatctgccagcccaaatttttacatgcagtctgccacacctctgtacaggcacttatcaccttattccactgtttagagacgaggcagcatgtgagtaaagtctgaggatcgagccattttaacaaataaaaactgagctccaggggaaggagtttgaggaagtcccgcttgaggagagtctctaggttattggagagatgcctgagctggactgccccactcagactaatcaggtgatccagagtttcatttttctgcaagtccgtcagagaaagaaatgtaacagaaatgttatcaagccatgtctcaaagtcctttctctccataaggttatggaaaaatttacctgtggcacatcaaaatattgtattagttctgctcaaaaagactgttcaagcaagactgctaacaaatgaagtattaaaaattagtgtaaaaaatctgccattacaactttatgcgtagttacattacaactttacagttaatacaccatatttatctgaacactttccatgcacacaaaagaaaacacatttgagaaaacatactttaacaaatcatgaatccaaaacatgtcagtgaaacagactggcgtgtgtgacttattcctcttgaagtctagcacgtgctacatgcatcttcatagtaatagatttaccaacaattcattataaaacagtatattttacaatacacccttcccccatcaaaaccattataaaacaatttccttaatgaattccttaatacattctatttgggtactaaaatcacaaaagcaagcaccaggatgtgacaatcagaaacagtctcctgagcagtaacctgagacactgattgtcatggcaggcacaacctgtcaccaaaatcatagaactgactacttggttttgcaacagatgttcagatgaaaaggtttagggaagaaaagcaggtgtggtaagttatctgcctcaggaattctggttcttccaacttctttatggcactgcctgtttagaacatgaattataaaagaacttatgtggctttagtctgtttttctaaacctcatatgagctagtgacaactcttaaccacgtgcccccgagagccatgaggggtcctggaggcctgcacaaataaagcaaattaataatcctgatgtttataaaacaccagaaaatagacattatcatcttcactttgcaaatgaggaaactacaggttagagaaggtatgtgatttgcctatattcacagggctactaaatagccacagaacagactggacgccagtgctctcaagatcaggtaccaagctctctctctaaaataagtgacaaccaggagaaccacgaccaagtggtaagatctggaggtagtgtgtctacccgttagaccattttctcctttaggagaatgacaaattgctcctgagctaactgtaacaaataattttttttaaagtatcctgtattagtgtcaacaggtgttaattcactcttaatgaggattagactaatgaaagattacaaaaaatataaccagtaaaaactatctttctcaagactatgtgttgatagatgttaatgctgggtgatgtgtacatagggatttattattctctttatttccatatatttaaatatttccatggtttaataaaaactttccttctgaatactcagtttctcacaagactgtcatattaattttaaaaacatatgtccaaattaatgtgaaaaaggaaagttaatttctttccagacatatcacctagatcaggtctacacaaaaagcaagatctcatctttcaactttgataatgtaaggtgagtaaaattgtaagtgtccaatatcaaatttggcaataacattcttagacaaataagcaatctgatttattagtagaagcaaccaaaccttgcaatcacatcatctgctaacagttttgatttctggaactgtgactagacttcaagataatacgtttcaagccaaagtttgggctagagaagatttattaatctgtattaaaaatttacctagctgacaaaaaataatcagatggctaaaagttttatcgacttatcacgcaataacaagccccctccttcctctaaatcctaacaaccctcttatctatacaacatttcttcaaaatctctacttctaaaaaataataatttgcaacaagacaaagcaattatcttctgtgggcatctgcatattgtcacaatagctagttaattaatactggtcaattaaaaacacacaccaggctgggcacagtggctcacgcctgtaatcacagcactttgtgagactgaggtgggctcggccggatcacgaggtcaggagatcgagatcatcctggctaacacagtgaaaccccatctctactaaaaatacaaaaaattcccctggcatggtggtgggtgcctgtagtcccagctagtcgggaggctgaggcaggagaatggcgtgaacccaggaggcggagcttgcagtgagccgagatcacgccactgcactccagccggggcgagagagcaagactccatctcaaaaaagaaaaaaaagaaaaaaaaccacacacctgctcctgaaacatttttaacagtgaaaagtgtggtgtggcaagcttcctccatcacatctacacatacatatatacacacatacatacacatgctgacacacatctattgtagaaatgcttgtatttaagtgagctgaactgttattcaaacggctacaaggcaaatttagaatactcattaaaatattatcaggttcccatcattcacaaatatctaagagacatactataatatgccaaattcacatgtatacctatgtaacaaacctgcacgttgtgcacatgtaccctagaacttaaatttaaaaaaaaaatgccaaattaatgtgcccatgacaccgctaaagattacggaagaagctttttcagagagcacatctaaaaaaattcagccatgtctcagatttatatattctcctaactcttaataaaaaaaattttcccaactcttagattgccttttaaaccactcaatcccttgtaagattgagcagttcacctctgattattctgaaaaaggcatttttttccctaaaaaagcaagtctcactaactgcagaatgcactatttaaaaaacaccaatttttacttttctgaacagatcaactaactttggagggggccttctaaggtaacaggtctaaactggactcttttaggcagcctctagaaatatcatacactggttgcacaaacctcaggaaatgggatttcaattcaacatgaggagcttttaaatctcagcgctttccaacaatggaatagctacctccagagtagtgagtttcccattaccacgaacagtcaaggacagttggacacagaggcagaatgtgataaatgaaaatactttggaggttggccagatgttttactgattcagccacttcctatgtgattatgggcatgtccaactaacttttaagcttcagttttatcatctgtaaaatggaagccatcatccaacttgaagggtgaaactcagaaatatagcagggacatgcttagcacagtgtacagtctagcgggtaaaaactcaaatggtactttttgttagttttactactatgaacacctggcagtaaagatttctgtgacactaagggtggaatggacatgaccactaacatctcttttgaccctatcatcttatcactaagtttctcttcaaaatacctggaagaaaaactcaagggctcaaacttactaggggtttaattttataaagaagagcacctgtttattggaggctctagtttcccagtaggtgccttattctacccacattccctgctgtttggcccccttaccctacgtccctaccccagagttaacattcaacttgccctcttgccttcagtatcaataatcacaaagtgggtcatgcaacaaaaagactcctaaattggaaaatgagagcctgggtttggtctcaggttctgccattaactccctatgttacctaggcaactcacatatttatattggttttaaagaaaaagtaccactggtaaacattatctcatttcatcttcataacctcatggaaggtatcagtaatgccgcccttaactaacattaatgaggaaatttacggctcaagaagtggagtggccttcccagaatggcacaggaagtagcaggctcaatattttgcccagtacccattctcccaaaacctatactcagaggtattagagacaggaccttctggaaaacagtgtaaatgtgttttcccctcctcctctatcagaacctggcctagtcaagagtgaaagcaacataattgttagtggtagagggaaggaggcttcatttcccccttttcttatcaaacaaagagcacagaggcgctgaaaatgtatacacacctataaacttacatatgcataaaatgtattctgaatattcaagaaactgataaccctggttgcctccagagagaactggagagctgcagaataggaatgaggggtccctttttattgtataccttttaaaactgaaaaccatgttaagtataatatactatcaaaaaatagcctttagttttaaggtgaatttttttaaagctttgaaagaatacaaataatgtttataaaatatgtgttctgcaactccacttgttgctgggtgaccttgggcaaatcacttcacctgtctcatgccctgtttcctcacttgtaaaatacagccaagagcattacctacaagggtttttatgagggttaaacaagacagtgcaagtaaagcgtttagcacagtactcggcacgctgtaagcctacagtaaatgtcagttaccattattacttagcattaatattgttatctttgctttacttcaagcagcaccccacatacacacctgttttcatggcatacccacaattatggcgcagtatagcgctttgtacttcataaaccacctcatcacacttcatcgtctttcaaacgtttggtagccctgggacatcactgttaactcatttcgcagctaaggaaatggaggcagtaggaggcagtaactccaaaaccctgttttcccgtctctaaaatccagatcccatcaacccattcgttgctcccaggtcccttgctctcggaatcgtgttccgcgcggcactgacctgagcgagcgccccggggcccgggacctcgcgccgggttcacagctactaggcacgctcggaccgccagagccttgcagcggccgggtccgctccgcagccatggcgcctgcagggaaagaaaaacagccaaggcgcggcgggtcagcagagccgcgggcgcctaagagtcccctccccgaccggccccgcctcgcatacagacccggacctgcggccgctgctcccggtccgcagcctcacaggggagcggcttccggtgctgcctgcgtcatctccgcgcgtccctcagctccgcggctcccggcggaagcggctgcacttccggtccccgcccggaggtgggtggtgggaggctggaggccgggagtaggggtggggagaagagcgtcccgggaagctgaacgcgtgccgcgcggccctcacggtgcttaggctgggtgcaacctagaacggaggttcctttcgtaccgtacatccaggtttgcacagcgcgcttatgtccctcctccaatctgatcttgcaccagctctgcagtagtttttcttattatcctcattttacggaggagagggagctgtggcttagagaagttaagagacgtgtccaaattcatacaacctgttgggcacctctttatcccgaacgctgttctaggggatagggttagtgaacaaaaaacgcaaaagcccctgaccgcctgggccttacatctattaggaggaggaagacagataaactaaggctcgtgcaaaggagaaaaataaagcaaggtaaggaggttgttgaatgaaaagagacagtcaagtgatgtagatttgaatgaatcacaacgtttacactctggctgtggcccggttacttaacctctcagactttgcttcatctgcatagcaattatagtgaggtccccatccgaaggctctgaggattgaaggaaatgaagcatgcaaaccttttggcgtcaagaactaaaactgagctaaaaaatcccacgcactctttctcaacattttttgtgtaccatctcactcagttcccacaacaaccccacaagctagtaactattattaggcccctttttagagatggggaaactgaaatcaaaagaggtttaggcatcttgcctaaggtcatagtaaatggctgtcataggatttcaacccaaaccgacttcagagcacaagttatcctttttttttttttgaggcaacgtatcactctgtcgcccaggctggagtacagtgacacgatcttggctcactgcagcctcgacttctccaggctcaagcgatcctcccacctcagcctcctgagtagaagggaccacaggcgcgtgtcaccatgcccagctagttgtgtgtgtgtgtgtgtgtgtgtgtgtgtgtgtgtgtgtgtatttttgtagagtcagggtttcgctatgttacccaggctggtcttgaactcctaggctcaagtgatccacctgcctgggcctcccaaaaagtgctgggattacaggggtgaaccacaatgcccagcgcacaagttatccttgtttctctgtaagggttcctaagccatacatgcatacacgcacattcacatacatcttataccaacactgtccaataagctttttgccagtgatggagttgttctgttggtgctgtccaataaggcagtcactagtctcttgtggctactgaacatttgaaaagtacctgatgtaaatgaactaaattcttaattttatttaattttaatttaatagccacatgaggctaatggctaccatgcttgatagcacagtccaataatatagacaataagagagacacatatccagtagatggtagagcatggccaaggttccaagcatcctgacttcatttagggtacttgaaacatgggaaataaaaattgattatgtggggtggaagtcaactacggtgtcctaaaagtaaggtctcaagagagcaaatttgatttgctaagcaacaggatgtcactctagacttctaagtcagaacgtgactgatcacagcattataagacatttaggaagacagatatacagattggatactctctatgaaagggaaggcagtaccagggtaatcaagaaaatcaagcacccatatctctttggagcaaacattctcaaccccagtacagtttgatgaatcaaattgaaaagtccagatggagctgccccagagataatattgtttggacctctcataacaaagaaaccaaattgtgcaaatttaagcccagaggggatccaggagcaaaattcatgactataaaaaaatttttaaattgcaaagtggacgtaatatttaattaaatacaagacctattgaattgttaaattcagaatatgtaaaaattccctttcatttgatatttttaggttagatttttcccactttgtaaagattttcaagattgtatgatggttgctgagaaaacatagccaactttaaatataagaagttattcctggccaaataattacaaaagctgttgtaaatggcagataggaagatcaacatgttggatgttgaaggaaaggacgaaatatagcctggcatgagaaaagaatgctcagtataattgcttgtgtgacaggaacatgaaaatatgctgaatgttgtttcttttctcgaaataaacttgctggtagaaatgatgtttgggataattcctacacatgcatactccaggaaaggagaaaacatcaaatgtttagtttcttcaattccggctaaagtggactgtatgttgtcttccattttgagctaaacttgcctggggaggtagtttagatgacttaaaattgatttagtaaagtgcttgcatagccaatactagggattctgaatccttcccaatgagccatacaccagacctcaccatatgatgtttctttgggagaaaataatgcacccactagggatgaaaaatcttcctctatgtctagtacagtttttgcatgtgtatgtaccagggagcaggcattactccagctgtttggtttcttgagatgcactccaaaaaaaagtataggatatatctacttgtgcaatgatgctatggagaagtgatctgggtaactgttctttgaacttccacacacactttaccaggaactcagcataaagacatggggtcagtttcatgaagtacacagggttggaagcatttgaagaggtttgctttgtctgttctttgttctggattcactctagctgtaacatgatcagcacccactctcctatgcagtcagcaggtattctaggataaaagctcaggttgattggcaagaaaccttatcctcaaaagttgaggcacaaagtactttactgcaattgctgttagactagagtgatcctgagatgcgtttgggcataattggcacctggactcaataatttctaagaccctgaagttgctcacaggcaacatgcaagtaagtttcttacaatctttaaagcatttgatatctagtaaaataggctttgaggaagctgaaatttttttctatgtgtaaatgagaaaatggaaaggagttcagattataattgctgggttttttttgttttgttgtgttttttgactgtttaaaggacatgggggccaggtgcggtggctcacgcctgtcatctcagcactttgggaggccgaggcaagcggatcacctgaggtcaggagttcaagaccagcctagccaatatggtgaaactccgtctctactacaaatacaaaaattagctgggagtggtggtgcatgcctgtaatcccagctacttgggaggctgaggcaggaaaatcacttgaacctgggaggcggaggttgcagtgagccaagatcatgccactgcagtccagcctgcgccacagagtgagactctgtctcaaaaataaagagaaagagagagagcaaggaagaagggagggagggagggagggggagacagagggaaagagagaaagaaagagaaagaaagaaaagaaagaaagagaaagaaagagataagtaaagataggaattgtgattctccaatggttaagagcgagctttggggctgggcacggtggctctcacctgtaatcccagcactttggaaggccgaggcaggtggatcacctgagatcaggagtttgaaaccagcctggccaacattgcaaaaccccatctctactaaaaataccaaaattagccaggcgtggtggcagacgcctgaaatcccagctactcaggaggctgaggcatgagaatcccttgaacccaggaggcagaggttgcagtgagccaagatcgcaccactgcactccagcctgggtgacagagcgagactccgtctcaaaaaaaaaaaaaaagaatgagctttggaatatgacagatttgagttcaaatcatgccctatcccaacctcttacccactgtgatcctgggcaaattactaaaccattaagctactcagatgctcagcttaattacgaaaataacatatctgaaagggatattaccagggctaaatgaattaagacacataaaagtgcttatcgcaatgcctggcacaaaagcaagtgcataataggaggtaacagttattatgggaggctttattgattgaagatccaatgaaaagggatttaattcatttaatgttccctggctctgttatactacaattctgcacatgccctttcagacagaaagtttccatctgtgttgatgaggtagagtaagcttggcctaggtctatcttacatctctgaagaggtgctatgcagatagcagtaatctgtccatattgatggaaatgtcagatagattaggagccattgtcaaaagaaactctgattcagtattagattaaattggaaagtcatactagaagaatgtaaatatttgatagtagccagggtgtcatggctaacaaaagcagccacttcatggaaaaatagcccctgacttttgtaattagagaagaaatggatccaggtgttcccattcaagaaagaacatcatgtattttcctacaggtttttatcacagtgataccacttgttaagttatatccatgtgtctgtgtccaattcttcttggtaatcccaatgtccaagacaagtgccttgtatatagtaaataagcttttatccaaacaagcaagaaaacaaccaactaacactttactcagtgttcactttgtgccaaatactggaatcagcagcactggagaagacagagacacgatgcctgctgtccaggagaccataatctagtggaagaaatagataatatatcacaataaacacttaaaatagagtgtactgctaaatgctgtgagaggtccgtatagggttcaatgagggcaaaaacaggaatagaggtgaagcctgaatgaacacgtgtcctttccttttttaggtgactttctgcagacttcggactcaccagtggtgtttcattctatttaatgtcatcctatttcatgccttgctttttgggactgactttgtggaggaatactttctgcattctttgccttatatagatgtgaaagttcttgaaattaagaataaggcaagaaaattgaacatcgaacccctaagaagtaatctctccaaatattatgtcctgagccagtcagaaatatgtaaagggaagaacatttttttgctgtctcttatcttcagtagcccaggaaatggaacaagacgggacctcattaggaaaacttggggcaatgtgaccagtgtccaagggcatcccattctcacactgtttgctctgggaatgcctgtttcggtaactacccagaaagagatcaacaaagaatcctgtaagaataatgatataattgaaggaatcttcttggacagttctgagaaccaaaccctgaagatcattgcaatgatacagtgggctgtggctttctgccctaatgccctgttcattctcaaggtggatgaagagacgtttgtcaatctaccaagcttggtagactatcttctcaatctgaaagaacacctagaagatatctatgtaggaagagttcttcatcaggttacacccaatagagatcctcagaacagagactttgtccctcttagtgagtacccagaaaaatactacccagattactgcagtggtgaggcctttataatgtcccaagatgtggctcgaatgatgtatgtggttttcaaagaagtacccatgatggtgccagctgatgtgtttgtaggaatttgtgctaagttcattggccttatacccatccacagctcaaggttttctgggaaaaggcacattagatacaacagatgttgctataagttcatttttacatcctcagaaattgcagatcctgaaatgcccctagcatggaaggaaattaatgatggaaaagaatgtacactgtttgagacatcctatgagctcatttcctgcaaacttctgacgtaccttgacagctttaaacgttttcacatggggaccataaaaaacaatctcatgtattttgctgattaggatttctttaattttccttatgagtctactattttaaagttaccttctaccctgttatggaaagcatcccttctttcccatgttttatgtaggttctctgaatctttaattttatttgcaaaggtacaaaatgttttctgtgctctggtgtgctcaattactgagatctcaaatttttaaaaaatttaagttggtgtagcataattcttttcaaaatgaaatatttctctcaaaagagagaacattatgtttcattgtttatttagttttcgttttttttttttcttttgagacagggtctggctctgtcacccaggctggagtgcagtggcgcaatctcgactcactgcaacctccaccgcctgggctcaagggatcctcccacctcagccttttgagtagctgagactataggcatgtgccaccatacccggctaatttttttttttttttttcggagacagagtcttgctctgtcgcccaggctggagtgcaatggcaccatctctgttcactgcaacctctgcctcccaggttaaagcaattctcctgcctcagcctcccaagtagctgggattacaggtgcctgccaccacgcctggctaatttttggtatttttagtagaggcggggtttcaccatgttggccaggctggtctcgaactcctggcctcaagtgatccacccgcctgggcctcccaaagtgctgggattacaggtgtgagccaccacgcctggcctaatttttgtatttttttatagagatgggggtttcatgatgttgcccacgctggtcttgaactcctgggctcaagtgatcctcccacctcagcctcccaaagtcccaaagtgttgggattataggtgtgaggaaccgtacctggccagtacacaattcattataactaagtttttttttttataaactgactagtaaaaattatgtatatttatgttgtacaacatgttttgatatatgtatatgttatagaatggctaaatcaagctatttaacacatgcatcacctgacatacttttttgtagtgagaacacttaaaatctactctactaacaattatcagatattgatatattgctgttaattgtcatgaccatgatgtatgatagagctcttgaacttattcctcatgtctaacaaaaatgttggatctcttggccatatctgccaagttttcccaacccccagtctctggtaacctccatttactctctgtttctatgaatttgagtttttttacactccacatataagtgagctcatgtgcttatttgtccttcaatgcctggtttatttcatgtaacataatgcactccaggttcatccatgttgttggaaatgacaggatttctttcatttataaggctgaatagcattttattgtggatatataccacattttctttattcatgcactggtggacacttagatagatgccactaatcttgtgaataatgctgcattgaatgtggggagtgcagatatctctttaacatactgatttaatatcttttggatatatttccagtagcggaattgctagattgtgtggcagttctatttttaattttgtgaggaacctccataatggctgtattattggtttaccataatggctcattgtggttttactttgcatttccctgatgattagtggtattgagcatttttttttcatatacctgttggccatttgtacttcttcttttgagaaatgtctatttagggcctttggtcatttctaagtcaggttatttgggcagggcacagtggctcatggctgtaatcccagcactttgggaggccaaggcaggtgggtcacctgagatgggaattcaagagcagcctggccaacagggtgaaaccccgcctctactaaacatacaaaaaattagctggacccggtggtacgtgcctgtaatcccagctacgcgggaggctgacacaggaaaatcgcttgaatccaggaggtggaggttgcagtgagccgagatcatgccactgcactccagcctgggcaacagtctgagactctatctcaaaaaacaaaataaaataaaataaataaagtgatttgctttcatgctattgtgttgtttgagtcccttatctatttggatattaaccccagaacagatatatggcttgcaaatattttctcccattccatagcttatctcttcactgattgctgcttttgatatgcacaagctttatagtttggtattatctcatttgtctattttagcttttgttgcctatacttaaggggtcatagccaagaaaatcttcgcccagaccaatgtcatggagcttcccccacctatgttttcttctagtagttgtacaggtcttacatttaaggtcttacatttaagtctttaatccgttgtgagttgatttttgtatatagtgtgagatgagggtatacttttattattctgcaggtagatatccatccagttttcccagcaccattcattgtaaagactatctttttcccattcagtgttcttggcatctttatcaaaaatcaattgactatcaatgaatgaatttatttctgggctctctattgtgttccattggtctgtgtgtctatttttatagtgtacatgctgtttagattactgtagctttgtaacagatgttcaaatccagtagtatgatgccttcggctttgttatttttgctcaagattgttttggctgttcaaagatttttgcattttcatatgaatattaggattttttttctatttccatgaaaaatatcattggagttttactagagtttgaattgaatctgtatgtggcttcaggtagcagggacattttaacattagtccttccaatccatgaacgtggcatatcttttctgtaatttgtgtcatcttcaatttctttcatcaacattttacagtttttattacacagatttttttacctccttatttaaatttactcctaagtattttgggttttttttcttttgatgctactataaaaaggatagttttctttttcagatagtacattgttagaatatgaaaatgctactgattttcataagttgatttttttccctgcaactttactgaatttggttgtcagttctaacagtttttgtttgtttgttttttgtttttgtttttgtttttgagatggagtctcgctctgttgcccaggctggagtgcagtggcacgatctcggctcactgcaacctccgcctcccaggttcaagcaattcccctgtctcagcctcctgagtagctgggactacgggcgcccgccaccacacccggctaatttttgtatttttagtagagacggggtttcaccatattgatcaggctagtctcaacctcctgacctcaggtgatccgcccacctcagcctcccaaaatgctgggattacaggcgtgagccactatgcccagtgcagttctaacagtttttgatggagtctttagggttttctcttataaggtcatattgtcagtaaacagtgacagtttcacttcttcctttcctatttggaaatatatatat

SEQ ID NO: 89 - DNA, 26767 bp, Homo sapiens
tatatactgtttatacagttaacactgtatagtgtttaactgataccattttagtttgggaagatgtaaagttctggaaatggatagtggtgatgactgcacaacaacgtaatgtacttaatggcactcaactgtatgctttaaaatgattaaaatggtaaattttatgttatgtatgttttcgcacaatttgcaaaaaaaaaggttatccaaactaattatttaaactagtttttataggaaaacattgtgccagttttacaccctaaaaaaaaataataataatcaggttgagtcgagttccatttatagtgatgcaagtctactcctgagaatcctttaggaatcactgttctctgctcctttctggctttatgtcagcctcccctctggactcccatttgctgcactggctaacccaacatgttttcaaagaggtcaccagtgatgcagcatagaggtgaaagaggactaaagaaatgtggactctcacactgcacgaaagaaaaaaatccctccccattcagtatcttaaaaatcttaataatactttaaaaaaaatcagactattgcacagaactctagatttcaggcttctcttgaagtcagatctaacaactctgaccctgaatcccacccacatggcaataatttattacaatggagcaccagctgcactctttagaaaggcaagtgttcttgatttgctatagtccacacagagacttttacctcagtcaggtcatcttcctggtcccagtgtgtatgttccacaagaaaaaactgctctaattcatccgtgtatgccctcacattgtttttcaaacagtaggcatcccataagtaaatatctactgaacagcacaaagcataatagattcctttcttaccatttcagaaataaattgcgaaagagaaagataactacctcaatgtcattagccattaatctcttcaataaaactgtctattgcttactcaaggcactaatgtgagagtcactaagtttattgccaaattcagggtttcccaattccaccacaatgagaattcaatctcttaagtaacaagatgacacaaacacatgtacaattctgtcacaaatacctctcttcacagttccagggatgctgctgttagaaaaattaaactaatactttggatcattttcaaccactgcacagcgtaattttaaatatgcaaacctgatgaatttaatcagaataaaaatcacattaacatacagacccaccaagagaataatcttaaaatgtagaattgtagatattaactttccaggtagttagagaattcagtgaatatttcccatttacttccactccaagtaactgcagtttttactacatttcaaaaataaggtttgatgagagaagaaaaaaactttttaaagcaagaggacctaggcatagtggctcacaccagtaatcctagcattttgggaggctgagacgggcggagtgcttgagcccaggagttcgagaccagcctgggcaacatggtgaaatcctgtctctacaaaaaatacaaaaaggatccaggcatagggttgctcgcttgtagtcccagctaaacccgggaggctgacatgggaggatcacctgagcccaggaggtggaggttgaagaaagccaagatcacatcattgcactccaggatggagctacccagtgagaggttgtctccaaaaaagaaaaaaaaaaaatgcggctgggtgcagtgcctcacacctgtaatcccagcactttgggaggccgaggcaggcagatcatctgagatcaggagtttgagaccagcctgaccaacatggtgaaaccccttctctactaaaaatacaaaaattagccgggctgtggtggcgcgtgcctgtaatgccagctactgaggaagctgaggcgagagaatcgcttgaacccaggaggaggaggttgcagtgagccgagactgcgccactgcactctagcccgggtgacagaggagctcctgtttcaaaaaaaaaaaaaaaaatgctacaggtggttgtgaaaaaatggtcaactgccagtaggagctccaagctccaagatgatactgcatcttaatattttttttttttttgagacagggttttgctgtgttgcccaggctggagtgcagtggcacaatcttagctcactgcaacctccacctcctgggctcaagcgatcctctcacctcagtctcccaagtagttgggaccacaggtgtgagccagcacacccagctgtttttttatttttttgtagagatgggattttgctatgttgcccaggctggtctcaaaactcctgggctcacataatctgcctgccttggcctcccaaagtgttgggactacaggcatgagccccctcatttggtcaactgcatcttaatcttttaaaatcatgaggcaaaagagacatggaaaagccatcaccacaacagagaaagtacatcaaagcctagaagaactggtgatgttgttctagtaatcaggcttgtaacacaaggaaaataaagtgtgaaataacttcaggatgacaaaccaaaccatgaaatgctttaaatcaaatgtttattttccaaaaccagcagagtgtctagcatttcagagaaaatatcaccacataatacatacccttaatgaataaagaaatgcattgtaaaacggtcttgagaaatgatacatctcaacattaaaaatatttaaattgagtctggtgagactcctgagggagaagcaagttacttaacactatattggtatggcatcaattcaatctatctggaaagggcactaagaagagctataaaattgggccgggcacggtggctcacgcctgtaatcccaacactttggagggtggatcacctgaggtcaggagtttgagaccagcctgggcaacaaggtgaaactccgcctctactaaaaatacaaaaaaaattagccgggtgtggtggcgcacacctgtaatcccagctactcgggaggctgaggcaggagactcgaaccctggaggcagaggttgcagtgagccgagattgcaccactgcactccaacctgggtgacagagtgagactccatctcaaaaaaaaaaaaaaaaaaaaaaaaagagctataaaataattcatacttctgtatctggtgattctacttttagacttctatcccaaatgaattcaagggaaaaagaggtaatacaaagacactaataaaaacagaaacaatctgaatatgcattgatatggttaagctttgtgtcctcacccaaacctcatcctgaactgtaatccccaggtattgagggacagacttggtgggaggtgactggatcatgggggtggccccccatgctgttctcatgatagtgagtgagttctctccagacctgatggttttataagggcctcttcctgcttcactcacactctctctctcctgctgccttgtgaacaaggtgcttgcttccccttcgccttccgccatgatcatattgccttctgacatgattgtaagtttcctgaggcctccccagccatgtggaactaggagtcaattaaacctcttttcttcataaattacccggtcttaggcagtttttttagcagtctgagaatggactaatatatgcattaatatggaaatggctaaataatgactattgatatatttacaaaaaggaacagtttataccgtaatacacaaatgtttattggaagttatcttggatgaaaaagaacaccaagtatttctatatattatatacaatgtaaggaaacaggcattgggattattagcaagaactgcctggagttattctaaatgctgcctaagaattatttacattgcctgtcaaaatgtattatctaacacatgggcattagttataatcatatacagaaacacacgtccattacaaatggaaaataacatataattttaaatttttaataattatattgtttcataaaattacttaattgcctagttaaaaaatatccagctctctctgttcccaggcccaaactccaacttctacttcttctacttagaatcacaggatttcagagcaaggaagaaatatctcctttcatatatacatatatatttattttgagatggagtctcactctgtcacccaggctggagtgcagtggcaccatctcagctcactggaacctccgcctcccgggttcaagcgattctcctgtttcagcctcccgagtagctgggattataggcgcatgccgccacgcccggctactttttcgtatttcagtagagacgggatttcaccatgttgaccagtctggtctcgaactcctgagctcaggcaatccacccgcctcggcttcccaaagtgctagaattacaggcatgagccactgcgcccgacctcctttcccatattttaaagatacagagaggttaagtaatttggccataatgatctaactacttgctaggattagataccaatttttccactgtttttttcctcaaatatcagtgccaacagaaaaagaaacagaatttagcaacagaggactacacatggaggaaacacaaagaaaaagtaatctatagctttgtaattcacataatgtttaaaagacagtctgaagtgtttttctcataaaattttataaaaatgattgtgttctctagagagaaggaagaggataaggggggggaaccactcaggattagagaaaaaaagtcactgtacatatctcatataatcaacacttgtcattctcaaagctcaagactggttcaagattacaccctatgaaatacaaaacaaaacccaaaaagcagtttcaacatctcttacctgtacagagaagtccatctttgtagtaaagtgcatacactctggcactgtgtccaattaatgacgaggtttcaaaggcttcatggtcctccagttgcttcattctcaaaatagccttcaaataaaccttcttccagtgcaaagcgtcctgaacagaatcatctatctgccagcccaaatttttacatgcagtctgccacacctctgtacaggcacttatcaccttattccactgtttagagacgaggcagcatgtgagtaaagtctgaggatcgagccattttaacaaataaaaactgagctccaggggaaggagtttgaggaagtcccgcttgaggagagtctctaggttattggagagatgcctgagctggactgccccactcagactaatcaggtgatccagagtttcatttttctgcaagtccgtcagagaaagaaatgtaacagaaatgttatcaagccatgtctcaaagtcctttctctccataaggttatggaaaaatttacctgtggcacatcaaaatattgtattagttctgctcaaaaagactgttcaagcaagactgctaacaaatgaagtattaaaaattagtgtaaaaaatctgccattacaactttatgcgtagttacattacaactttacagttaatacaccatatttatctgaacactttccatgcacacaaaagaaaacacatttgagaaaacatactttaacaaatcatgaatccaaaacatgtcagtgaaacagactggcgtgtgtgacttattcctcttgaagtctagcacgtgctacatgcatcttcatagtaatagatttaccaacaattcattataaaacagtatattttacaatacacccttcccccatcaaaaccattataaaacaatttccttaatgaattccttaatacattctatttgggtactaaaatcacaaaagcaagcaccaggatgtgacaatcagaaacagtctcctgagcagtaacctgagacactgattgtcatggcaggcacaacctgtcaccaaaatcatagaactgactacttggttttgcaacagatgttcagatgaaaaggtttagggaagaaaagcaggtgtggtaagttatctgcctcaggaattctggttcttccaacttctttatggcactgcctgtttagaacatgaattataaaagaacttatgtggctttagtctgtttttctaaacctcatatgagctagtgacaactcttaaccacgtgcccccgagagccatgaggggtcctggaggcctgcacaaataaagcaaattaataatcctgatgtttataaaacaccagaaaatagacattatcatcttcactttgcaaatgaggaaactacaggttagagaaggtatgtgatttgcctatattcacagggctactaaatagccacagaacagactggacgccagtgctctcaagatcaggtaccaagctctctctctaaaataagtgacaaccaggagaaccacgaccaagtggtaagatctggaggtagtgtgtctacccgttagaccattttctcctttaggagaatgacaaattgctcctgagctaactgtaacaaataattttttttaaagtatcctgtattagtgtcaacaggtgttaattcactcttaatgaggattagactaatgaaagattacaaaaaatataaccagtaaaaactatctttctcaagactatgtgttgatagatgttaatgctgggtgatgtgtacatagggatttattattctctttatttccatatatttaaatatttccatggtttaataaaaactttccttctgaatactcagtttctcacaagactgtcatattaattttaaaaacatatgtccaaattaatgtgaaaaaggaaagttaatttctttccagacatatcacctagatcaggtctacacaaaaagcaagatctcatctttcaactttgataatgtaaggtgagtaaaattgtaagtgtccaatatcaaatttggcaataacattcttagacaaataagcaatctgatttattagtagaagcaaccaaaccttgcaatcacatcatctgctaacagttttgatttctggaactgtgactagacttcaagataatacgtttcaagccaaagtttgggctagagaagatttattaatctgtattaaaaatttacctagctgacaaaaaataatcagatggctaaaagttttatcgacttatcacgcaataacaagccccctccttcctctaaatcctaacaaccctcttatctatacaacatttcttcaaaatctctacttctaaaaaataataatttgcaacaagacaaagcaattatcttctgtgggcatctgcatattgtcacaatagctagttaattaatactggtcaattaaaaacacacaccaggctgggcacagtggctcacgcctgtaatcacagcactttgtgagactgaggtgggctcggccggatcacgaggtcaggagatcgagatcatcctggctaacacagtgaaaccccatctctactaaaaatacaaaaaattcccctggcatggtggtgggtgcctgtagtcccagctagtcgggaggctgaggcaggagaatggcgtgaacccaggaggcggagcttgcagtgagccgagatcacgccactgcactccagccggggcgagagagcaagactccatctcaaaaaagaaaaaaaagaaaaaaaaccacacacctgctcctgaaacatttttaacagtgaaaagtgtggtgtggcaagcttcctccatcacatctacacatacatatatacacacatacatacacatgctgacacacatctattgtagaaatgcttgtatttaagtgagctgaactgttattcaaacggctacaaggcaaatttagaatactcattaaaatattatcaggttcccatcattcacaaatatctaagagacatactataatatgccaaattcacatgtatacctatgtaacaaacctgcacgttgtgcacatgtaccctagaacttaaatttaaaaaaaaaatgccaaattaatgtgcccatgacaccgctaaagattacggaagaagctttttcagagagcacatctaaaaaaattcagccatgtctcagatttatatattctcctaactcttaataaaaaaaattttcccaactcttagattgccttttaaaccactcaatcccttgtaagattgagcagttcacctctgattattctgaaaaaggcatttttttccctaaaaaagcaagtctcactaactgcagaatgcactatttaaaaaacaccaatttttacttttctgaacagatcaactaactttggagggggccttctaaggtaacaggtctaaactggactcttttaggcagcctctagaaatatcatacactggttgcacaaacctcaggaaatgggatttcaattcaacatgaggagcttttaaatctcagcgctttccaacaatggaatagctacctccagagtagtgagtttcccattaccacgaacagtcaaggacagttggacacagaggcagaatgtgataaatgaaaatactttggaggttggccagatgttttactgattcagccacttcctatgtgattatgggcatgtccaactaacttttaagcttcagttttatcatctgtaaaatggaagccatcatccaacttgaagggtgaaactcagaaatatagcagggacatgcttagcacagtgtacagtctagcgggtaaaaactcaaatggtactttttgttagttttactactatgaacacctggcagtaaagatttctgtgacactaagggtggaatggacatgaccactaacatctcttttgaccctatcatcttatcactaagtttctcttcaaaatacctggaagaaaaactcaagggctcaaacttactaggggtttaattttataaagaagagcacctgtttattggaggctctagtttcccagtaggtgccttattctacccacattccctgctgtttggcccccttaccctacgtccctaccccagagttaacattcaacttgccctcttgccttcagtatcaataatcacaaagtgggtcatgcaacaaaaagactcctaaattggaaaatgagagcctgggtttggtctcaggttctgccattaactccctatgttacctaggcaactcacatatttatattggttttaaagaaaaagtaccactggtaaacattatctcatttcatcttcataacctcatggaaggtatcagtaatgccgcccttaactaacattaatgaggaaatttacggctcaagaagtggagtggccttcccagaatggcacaggaagtagcaggctcaatattttgcccagtacccattctcccaaaacctatactcagaggtattagagacaggaccttctggaaaacagtgtaaatgtgttttcccctcctcctctatcagaacctggcctagtcaagagtgaaagcaacataattgttagtggtagagggaaggaggcttcatttcccccttttcttatcaaacaaagagcacagaggcgctgaaaatgtatacacacctataaacttacatatgcataaaatgtattctgaatattcaagaaactgataaccctggttgcctccagagagaactggagagctgcagaataggaatgaggggtccctttttattgtataccttttaaaactgaaaaccatgttaagtataatatactatcaaaaaatagcctttagttttaaggtgaatttttttaaagctttgaaagaatacaaataatgtttataaaatatgtgttctgcaactccacttgttgctgggtgaccttgggcaaatcacttcacctgtctcatgccctgtttcctcacttgtaaaatacagccaagagcattacctacaagggtttttatgagggttaaacaagacagtgcaagtaaagcgtttagcacagtactcggcacgctgtaagcctacagtaaatgtcagttaccattattacttagcattaatattgttatctttgctttacttcaagcagcaccccacatacacacctgttttcatggcatacccacaattatggcgcagtatagcgctttgtacttcataaaccacctcatcacacttcatcgtctttcaaacgtttggtagccctgggacatcactgttaactcatttcgcagctaaggaaatggaggcagtaggaggcagtaactccaaaaccctgttttcccgtctctaaaatccagatcccatcaacccattcgttgctcccaggtcccttgctctcggaatcgtgttccgcgcggcactgacctgagcgagcgccccggggcccgggacctcgcgccgggttcacagctactaggcacgctcggaccgccagagccttgcagcggccgggtccgctccgcagccatggcgcctgcagggaaagaaaaacagccaaggcgcggcgggtcagcagagccgcgggcgcctaagagtcccctccccgaccggccccgcctcgcatacagacccggacctgcggccgctgctcccggtccgcagcctcacaggggagcggcttccggtgctgcctgcgtcatctccgcgcgtccctcagctccgcggctcccggcggaagcggctgcacttccggtccccgcccggaggtgggtggtgggaggctggaggccgggagtaggggtggggagaagagcgtcccgggaagctgaacgcgtgccgcgcggccctcacggtgcttaggctgggtgcaacctagaacggaggttcctttcgtaccgtacatccaggtttgcacagcgcgcttatgtccctcctccaatctgatcttgcaccagctctgcagtagtttttcttattatcctcattttacggaggagagggagctgtggcttagagaagttaagagacgtgtccaaattcatacaacctgttgggcacctctttatcccgaacgctgttctaggggatagggttagtgaacaaaaaacgcaaaagcccctgaccgcctgggccttacatctattaggaggaggaagacagataaactaaggctcgtgcaaaggagaaaaataaagcaaggtaaggaggttgttgaatgaaaagagacagtcaagtgatgtagatttgaatgaatcacaacgtttacactctggctgtggcccggttacttaacctctcagactttgcttcatctgcatagcaattatagtgaggtccccatccgaaggctctgaggattgaaggaaatgaagcatgcaaaccttttggcgtcaagaactaaaactgagctaaaaaatcccacgcactctttctcaacattttttgtgtaccatctcactcagttcccacaacaaccccacaagctagtaactattattaggcccctttttagagatggggaaactgaaatcaaaagaggtttaggcatcttgcctaaggtcatagtaaatggctgtcataggatttcaacccaaaccgacttcagagcacaagttatcctttttttttttttgaggcaacgtatcactctgtcgcccaggctggagtacagtgacacgatcttggctcactgcagcctcgacttctccaggctcaagcgatcctcccacctcagcctcctgagtagaagggaccacaggcgcgtgtcaccatgcccagctagttgtgtgtgtgtgtgtgtgtgtgtgtgtgtgtgtgtgtgtgtatttttgtagagtcagggtttcgctatgttacccaggctggtcttgaactcctaggctcaagtgatccacctgcctgggcctcccaaaaagtgctgggattacaggggtgaaccacaatgcccagcgcacaagttatccttgtttctctgtaagggttcctaagccatacatgcatacacgcacattcacatacatcttataccaacactgtccaataagctttttgccagtgatggagttgttctgttggtgctgtccaataaggcagtcactagtctcttgtggctactgaacatttgaaaagtacctgatgtaaatgaactaaattcttaattttatttaattttaatttaatagccacatgaggctaatggctaccatgcttgatagcacagtccaataatatagacaataagagagacacatatccagtagatggtagagcatggccaaggttccaagcatcctgacttcatttagggtacttgaaacatgggaaataaaaattgattatgtggggtggaagtcaactacggtgtcctaaaagtaaggtctcaagagagcaaatttgatttgctaagcaacaggatgtcactctagacttctaagtcagaacgtgactgatcacagcattataagacatttaggaagacagatatacagattggatactctctatgaaagggaaggcagtaccagggtaatcaagaaaatcaagcacccatatctctttggagcaaacattctcaaccccagtacagtttgatgaatcaaattgaaaagtccagatggagctgccccagagataatattgtttggacctctcataacaaagaaaccaaattgtgcaaatttaagcccagaggggatccaggagcaaaattcatgactataaaaaaatttttaaattgcaaagtggacgtaatatttaattaaatacaagacctattgaattgttaaattcagaatatgtaaaaattccctttcatttgatatttttaggttagatttttcccactttgtaaagattttcaagattgtatgatggttgctgagaaaacatagccaactttaaatataagaagttattcctggccaaataattacaaaagctgttgtaaatggcagataggaagatcaacatgttggatgttgaaggaaaggacgaaatatagcctggcatgagaaaagaatgctcagtataattgcttgtgtgacaggaacatgaaaatatgctgaatgttgtttcttttctcgaaataaacttgctggtagaaatgatgtttgggataattcctacacatgcatactccaggaaaggagaaaacatcaaatgtttagtttcttcaattccggctaaagtggactgtatgttgtcttccattttgagctaaacttgcctggggaggtagtttagatgacttaaaattgatttagtaaagtgcttgcatagccaatactagggattctgaatccttcccaatgagccatacaccagacctcaccatatgatgtttctttgggagaaaataatgcacccactagggatgaaaaatcttcctctatgtctagtacagtttttgcatgtgtatgtaccagggagcaggcattactccagctgtttggtttcttgagatgcactccaaaaaaaagtataggatatatctacttgtgcaatgatgctatggagaagtgatctgggtaactgttctttgaacttccacacacactttaccaggaactcagcataaagacatggggtcagtttcatgaagtacacagggttggaagcatttgaagaggtttgctttgtctgttctttgttctggattcactctagctgtaacatgatcagcacccactctcctatgcagtcagcaggtattctaggataaaagctcaggttgattggcaagaaaccttatcctcaaaagttgaggcacaaagtactttactgcaattgctgttagactagagtgatcctgagatgcgtttgggcataattggcacctggactcaataatttctaagaccctgaagttgctcacaggcaacatgcaagtaagtttcttacaatctttaaagcatttgatatctagtaaaataggctttgaggaagctgaaatttttttctatgtgtaaatgagaaaatggaaaggagttcagattataattgctgggttttttttgttttgttgtgttttttgactgtttaaaggacatgggggccaggtgcggtggctcacgcctgtcatctcagcactttgggaggccgaggcaagcggatcacctgaggtcaggagttcaagaccagcctagccaatatggtgaaactccgtctctactacaaatacaaaaattagctgggagtggtggtgcatgcctgtaatcccagctacttgggaggctgaggcaggaaaatcacttgaacctgggaggcggaggttgcagtgagccaagatcatgccactgcagtccagcctgcgccacagagtgagactctgtctcaaaaataaagagaaagagagagagcaaggaagaagggagggagggagggagggggagacagagggaaagagagaaagaaagagaaagaaagaaaagaaagaaagagaaagaaagagataagtaaagataggaattgtgattctccaatggttaagagcgagctttggggctgggcacggtggctctcacctgtaatcccagcactttggaaggccgaggcaggtggatcacctgagatcaggagtttgaaaccagcctggccaacattgcaaaaccccatctctactaaaaataccaaaattagccaggcgtggtggcagacgcctgaaatcccagctactcaggaggctgaggcatgagaatcccttgaacccaggaggcagaggttgcagtgagccaagatcgcaccactgcactccagcctgggtgacagagcgagactccgtctcaaaaaaaaaaaaaaagaatgagctttggaatatgacagatttgagttcaaatcatgccctatcccaacctcttacccactgtgatcctgggcaaattactaaaccattaagctactcagatgctcagcttaattacgaaaataacatatctgaaagggatattaccagggctaaatgaattaagacacataaaagtgcttatcgcaatgcctggcacaaaagcaagtgcataataggaggtaacagttattatgggaggctttattgattgaagatccaatgaaaagggatttaattcatttaatgttccctggctctgttatactacaattctgcacatgccctttcagacagaaagtttccatctgtgttgatgaggtagagtaagcttggcctaggtctatcttacatctctgaagaggtgctatgcagatagcagtaatctgtccatattgatggaaatgtcagatagattaggagccattgtcaaaagaaactctgattcagtattagattaaattggaaagtcatactagaagaatgtaaatatttgatagtagccagggtgtcatggctaacaaaagcagccacttcatggaaaaatagcccctgacttttgtaattagagaagaaatggatccaggtgttcccattcaagaaagaacatcatgtattttcctacaggtttttatcacagtgataccacttgttaagttatatccatgtgtctgtgtccaattcttcttggtaatcccaatgtccaagacaagtgccttgtatatagtaaataagcttttatccaaacaagcaagaaaacaaccaactaacactttactcagtgttcactttgtgccaaatactggaatcagcagcactggagaagacagagacacgatgcctgctgtccaggagaccataatctagtggaagaaatagataatatatcacaataaacacttaaaatagagtgtactgctaaatgctgtgagaggtccgtatagggttcaatgagggcaaaaacaggaatagaggtgaagcctgaatgaacacgtgtcctttccttttttaggtgactttctgcagacttcggactcaccagtggtgtttcattctatttaatgtcatcctatttcatgccttgctttttgggactgactttgtggaggaatactttctgcattctttgccttatatagatgtgaaagttcttgaaattaagaataaggcaagaaaattgaacatcgaacccctaagaagtaatctctccaaatattatgtcctgagccagtcagaaatatgtaaagggaagaacatttttttgctgtctcttatcttcagtagcccaggaaatggaacaagacgggacctcattaggaaaacttggggcaatgtgaccagtgtccaagggcatcccattctcacactgtttgctctgggaatgcctgtttcggtaactacccagaaagagatcaacaaagaatcctgtaagaataatgatataattgaaggaatcttcttggacagttctgagaaccaaaccctgaagatcattgcaatgatacagtgggctgtggctttctgccctaatgccctgttcattctcaaggtggatgaagagacgtttgtcaatctaccaagcttggtagactatcttctcaatctgaaagaacacctagaagatatctatgtaggaagagttcttcatcaggttacacccaatagagatcctcagaacagagactttgtccctcttagtgagtacccagaaaaatactacccagattactgcagtggtgaggcctttataatgtcccaagatgtggctcgaatgatgtatgtggttttcaaagaagtacccatgatggtgccagctgatgtgtttgtaggaatttgtgctaagttcattggccttatacccatccacagctcaaggttttctgggaaaaggcacattagatacaacagatgttgctataagttcatttttacatcctcagaaattgcagatcctgaaatgcccctagcatggaaggaaattaatgatggaaaagaatgtacactgtttgagacatcctatgagctcatttcctgcaaacttctgacgtaccttgacagctttaaacgttttcacatggggaccataaaaaacaatctcatgtattttgctgattaggatttctttaattttccttatgagtctactattttaaagttaccttctaccctgttatggaaagcatcccttctttcccatgttttatgtaggttctctgaatctttaattttatttgcaaaggtacaaaatgttttctgtgctctggtgtgctcaattactgagatctcaaatttttaaaaaatttaagttggtgtagcataattcttttcaaaatgaaatatttctctcaaaagagagaacattatgtttcattgtttatttagttttcgttttttttttttcttttgagacagggtctggctctgtcacccaggctggagtgcagtggcgcaatctcgactcactgcaacctccaccgcctgggctcaagggatcctcccacctcagccttttgagtagctgagactataggcatgtgccaccatacccggctaatttttttttttttttttcggagacagagtcttgctctgtcgcccaggctggagtgcaatggcaccatctctgttcactgcaacctctgcctcccaggttaaagcaattctcctgcctcagcctcccaagtagctgggattacaggtgcctgccaccacgcctggctaatttttggtatttttagtagaggcggggtttcaccatgttggccaggctggtctcgaactcctggcctcaagtgatccacccgcctgggcctcccaaagtgctgggattacaggtgtgagccaccacgcctggcctaatttttgtatttttttatagagatgggggtttcatgatgttgcccacgctggtcttgaactcctgggctcaagtgatcctcccacctcagcctcccaaagtcccaaagtgttgggattataggtgtgaggaaccgtacctggccagtacacaattcattataactaagtttttttttttataaactgactagtaaaaattatgtatatttatgttgtacaacatgttttgatatatgtatatgttatagaatggctaaatcaagctatttaacacatgcatcacctgacatacttttttgtagtgagaacacttaaaatctactctactaacaattatcagatattgatatattgctgttaattgtcatgaccatgatgtatgatagagctcttgaacttattcctcatgtctaacaaaaatgttggatctcttggccatatctgccaagttttcccaacccccagtctctggtaacctccatttactctctgtttctatgaatttgagtttttttacactccacatataagtgagctcatgtgcttatttgtccttcaatgcctggtttatttcatgtaacataatgcactccaggttcatccatgttgttggaaatgacaggatttctttcatttataaggctgaatagcattttattgtggatatataccacattttctttattcatgcactggtggacacttagatagatgccactaatcttgtgaataatgctgcattgaatgtggggagtgcagatatctctttaacatactgatttaatatcttttggatatatttccagtagcggaattgctagattgtgtggcagttctatttttaattttgtgaggaacctccataatggctgtattattggtttaccataatggctcattgtggttttactttgcatttccctgatgattagtggtattgagcatttttttttcatatacctgttggccatttgtacttcttcttttgagaaatgtctatttagggcctttggtcatttctaagtcaggttatttgggcagggcacagtggctcatggctgtaatcccagcactttgggaggccaaggcaggtgggtcacctgagatgggaattcaagagcagcctggccaacagggtgaaaccccgcctctactaaacatacaaaaaattagctggacccggtggtacgtgcctgtaatcccagctacgcgggaggctgacacaggaaaatcgcttgaatccaggaggtggaggttgcagtgagccgagatcatgccactgcactccagcctgggcaacagtctgagactctatctcaaaaaacaaaataaaataaaataaataaagtgatttgctttcatgctattgtgttgtttgagtcccttatctatttggatattaaccccagaacagatatatggcttgcaaatattttctcccattccatagcttatctcttcactgattgctgcttttgatatgcacaagctttatagtttggtattatctcatttgtctattttagcttttgttgcctatacttaaggggtcatagccaagaaaatcttcgcccagaccaatgtcatggagcttcccccacctatgttttcttctagtagttgtacaggtcttacatttaaggtcttacatttaagtctttaatccgttgtgagttgatttttgtatatagtgtgagatgagggtatacttttattattctgcaggtagatatccatccagttttcccagcaccattcattgtaaagactatctttttcccattcagtgttcttggcatctttatcaaaaatcaattgactatcaatgaatgaatttatttctgggctctctattgtgttccattggtctgtgtgtctatttttatagtgtacatgctgtttagattactgtagctttgtaacagatgttcaaatccagtagtatgatgccttcggctttgttatttttgctcaagattgttttggctgttcaaagatttttgcattttcatatgaatattaggattttttttctatttccatgaaaaatatcattggagttttactagagtttgaattgaatctgtatgtggcttcaggtagcagggacattttaacattagtccttccaatccatgaacgtggcatatcttttctgtaatttgtgtcatcttcaatttctttcatcaacattttacagtttttattacacagatttttttacctccttatttaaatttactcctaagtattttgggttttttttcttttgatgctactataaaaaggatagttttctttttcagatagtacattgttagaatatgaaaatgctactgattttcataagttgatttttttccctgcaactttactgaatttggttgtcagttctaacagtttttgtttgtttgttttttgtttttgtttttgtttttgagatggagtctcgctctgttgcccaggctggagtgcagtggcacgatctcggctcactgcaacctccgcctcccaggttcaagcaattcccctgtctcagcctcctgagtagctgggactacgggcgcccgccaccacacccggctaatttttgtatttttagtagagacggggtttcaccatattgatcaggctagtctcaacctcctgacctcaggtgatccgcccacctcagcctcccaaaatgctgggattacaggcgtgagccactatgcccagtgcagttctaacagtttttgatggagtctttagggttttctcttataaggtcatattgtcagtaaacagtgacagtttcacttcttcctttcctatttggaaatatatatatttttaatttttatattatatatatatatatattcaagacaagatctcgctctgttgcccaggctggaatgcaatggcatgaacacagctcaccgcatccttgacctcccaagttcaatagatcctcttgcctcagccccccgagtagctgagaatacaggtgtgcaccacctcgcccagataatttttgtattttttacagagatgggatcttgccatgttgcccagggtggtcttgaactcctggcctcagtgatcctcctgcctcagcttcccaaagtgttgggattacaggtgtgagctgccacacctggcctatttggctaattttatttctttttctttcctttttttttttttttttttgagatggagtctcactctgtcgcccaggctggagtgcaatggcgtgatctcagctcatcgcaacctccgcctcctgggttcaagggattctcctgcctcagcctcccgagtagttgggattacaggcacccatcaccactcccggctgatttttgtatttttaatagagaagaggtttcaccatgttggccaggctggtctcgaactcctgacctcaggtgatccgtctgcctcggcctcccaaagtgctgggattacaggcattagccactgcacccagccaattttatttctttttcttgtctatttgctctggctaggacttccaatactatactgaacagaagtgagagtgagcatccttgtcttgtttctgattttagaggagaagcttttaactttatttttctgttgagaatgatgttagctatgtgtttgtcatgtgtgacttttattgtgttgaggtacattcttttaatactttatttttgaaagtttttatcaggaaaaaatgttgaattttaccatatgccttttttgcatctattgagatgctcatataattttgtccccttcattctgttaacgtagtgtatcatctttatagatttgtgtatgttgagctatccttgcatccctgggataaatcccactggattatgatgaataatccctttcatgtgctgttgaatttagtttgctagtattttattgaggatttttgtacctatgtttatcagggatattggctgggatcttgtttatttgtggcttgtaattttcttttcatgtagtctctttgtctggctttgctatcagggtaatgctgacctcacaaaatgagtttgaaagtattccctcttctgttttgaggggagagtttgagaaggattggtattaattcttctttaagtgtttggtagatggcttcagcagttggtgggagattttttattgctgattcaatctctttactctgtgctggtcggttcagattttccatttcctcatgatttaggattgataagttgtatgtgtccaggaatgtatccatttcttctaagttatccatgttgttgttgtataattgttcatagttgtctctaaaaattctatttttttttttttttttttttttttgagacggagtcttgctctttcgcccaggctggagtgctggagtgcagtggcgttatcttggctcatggcaacctccacctcccaggttcaagtgattttcctgcctcagcctctctagtgttgtgggaatcaggaggaccagagagaccttggggtatatacaggaggatctttattgagtgcactcagacccagcagacttaacatccaaaaactaggcctggaaaaaagacagcacttgacttttatacacacttcaaaaagtgggtgggctagcttgaagcaggcttatagtggcatgaaagcaaggatacagaggcagaacaaagacagttaatcaaattgtgacaggttcataactcaggattacacatggccgttgttatgcagcccagatgtctgttatctaggtttgctctagtgcctagcacgggcttatccataactttcactatggtgcccaggtggctgtatctcaggcctgctcagatggtttatggccttcactccactgcttagataaaacaatacttgaagttactagttacagagaacaggaatctataaactcataccataagagaaaggaaaatttgtttttctcctcctgatgttgagggagtgctggaagagttcttcggggcacattagatagtattagcaagacttttcctgggtctgggctgtgcctgtcgctgctgtgggacaagtcagcctaatacaggaaagcttatttctctctcttttttttacattttacttttctttatttctttaatttcccacctcactagtagctgggattacaggtgcgtgccatcatgcctggctaattttttgtatttttaatagagatggggtttcaccatgttggccaggctagttttgaactgctgacctcaagtgatcacccgcctcagcctcccaaagtgctgggattataggcgtgagccaccatgcacaaccaattctttatgtttttgtgttatcagttttaatatctctttcatttctgattctgcttgagtcttatctctatttttttcttatttagtctacctaagggtttgtcaactttatcttttaaaaaaaaacaactcttagtttcattagtcttttgtgtcatttttctggtgtctacttttttaatttctgccctgatctttgttatttccttccttctgctaccttagtttcttcttcttcttcttgtttttttttttttgttgttgttgtttgtttgttttttagacagagtttccctcttgttgcccaggctggagtgcaatggcacaatctcagctcactgcaacctccacctcccaggttcaagcaattctcctgcctcagcctcccaagtagctgagattacaggcatgcgtcagcacacccagctaatttttatatttttagtagagatggggtttcgccatgttgatcaggctggatagtcttgaactcctgatcttgggtgatccatccgcctcggcctcccaaagtgctggtattacaggcgtgagccactgtgcctggccagtttgttcttttattttttattttttattttgtttaatttttttgaggcagagtctcactctgtcacccaggctggagtgcaatggcacgatctcagctcactgcaagctccgcctcccgggtacccgccattctcctgcctcagcctcccgagcagctgggactacaggcgcccgccaccatgctcagctaattttttgtgtatttttagtagagatggggtttcactgtgttagccaggatgatctcgatctcctgacctcatgatccacccgcctcggcctcccaaagtgctgggattacaggcatgagccactgcacccggccattcttctttcatagtttccttgagatgtaatgttaggttgttaatttgtgatatttctttccttttgatgtaggcatttagtaccatgaacttcccttttagaactgcttttgatgtatcttacaagtcttcatttgtcacaagatatttttaaatttcccttttaatttatttgacccaacatttgttcaggagcatattattttatttccaagtatttattcattttccttgatttctcctgttactgatgtctagtttcgtaccaatatggtcacaaaagatacttaatatgatttcaatcttcttaaatttttaaagacttttctatgggctaacatgatgtatcctggataatgtgatgtgtgtgcttgagaagaatgtgtattctattgcttttggatataatgttttgtatatttctgttagatccattttgtctaaagtgtagctcaagtccagtgttttcttattgattttctgtttgaatgatctgtctattgttaaaaatgaagtattgaatccctactactattgtgttatagtctctctactataggctttgctctgtaattaccctgaggcttacataaaacaccttactacaggctattttaagttgacaacaacttaattttcattttaatgtcatactcaaactgtatgcttttattccccctcctctcatgttttatgcttttgatgccacacttcatacctttttataatttgtatcctttaaccagttattatagctttagttgtttttaatagttttgcatttaatctttatactatatactttaatctttatactttataccagagatataattcattgcccactgccactgcagaaatagagaatttggatttgacaatgtgcttactttttccagtgacttttatattttcatatgttcttatgttactgcttagcatcctcttccttcagcttgaagaactccctttagcattttttgtaaggcaggcctagtggtgacagactctctcaatttttgtttaagtctttatcaccctttcatttttgaaagacaggattatttgatatagtattcttggtcagcaggtttgttttttttttccttttaggattttgaatataccattccattcctttcttgactgcaaggtttctgaagataaatctgctgatagtcttatatatgttccattgtatgtgacaatttgctttttccttgctgctttcagcactttcactttgtctttaacttttgacaatttgattatgatgtgtcttgatgtgggtctctttggatttatcatttgctgtactttgggcttcttggatctggcttttaatttcctttcctagacttggaaagttttctgtcattgtttctttgaatatattctctatgcttttctttttctccctctccttcttctggtacactaacaatgcataagtttttcaatagatgttgttccataagtctcttaaattatctacattccttaattttttaatttttgctcccagattgaatgatttccagtgacctgtcttcaagttcattggtcctttcttctgcttgatctggtctgctgttgaacccctctattgaatttttcagtttagttatagtattcttcagatttgtaatttctgtttggtacttttttatactttctttttgttgaaattcccagtttgttcttatattgacctcttgactttggagagcatctttattactattattattatcattattattattattattattattgagacagagtccactctgttgcccaggctgaagtgcagtggtatgatcttggctcactacagcctccacctcctggtttcaagtgattcttgtgcctcggcctccaaagtagctgggactacagtcatgtgccaccacacctggctattttttttctatttttagtagagatgggtttccaccatgttggacaggctggtctcaaactcctggcttcaagtcatctactcacctcagcttcccacagtgctagggttacaggcatgagccactactagcagcctatcaccattattttgaattgctgtcaggtcaaacaatatctcccattcgtttgggttagtttctgtagaattatcttgctcttttatttgtttcttcatttcccttgactctctgtgttggtttctgtgcattagataagacaaataactcgtccagtattgtgaggctggccttatataggagaagaatctcacctatctgtccagccacccgccttggcctcccaaagtgctgggattacaggtgtgagccaccatgtcctgcctacagtataagttctttcatgtttttgaaagaaactggaacaaaagattttatcatattttttatattcataggatttttctcaagtgtgaatctgtttatgtttttgaaggtacctgatatatctgaatgctttccttattccttacaaggaacaggttttctatgcagtttgagttatttcatgtatttgacagaaactggaaaggccacatttttttaatgctcataggatccttctccatttttaatctattcatgtgttggaaaggaactgggataattaaatgctttcctacattcctttccttcattggatgtctttgtttttttgttttttgtttttgtttttttttttgagacagagtttcactctgtcacccaggatagagtgcagcggctcattgcagccttgagctcttgggctcaagcagtcctcttgcctctgtcttttggttagctaggacaacaggtgtgtaccaccatgcctggctgatttttcattatttttggaacagatgaggtctcactacgttgcccaggctggtctcgaactcctgtacttaagtgaccctcctgcctcggcctccctgagtgctggaattagaggcatgagccactgcacctggcctctattgcacttttcattgcattcattgtattttttcaattccagaatctttttaatccaactgaatatatttattacaagtgcattgagactatacaga

SEQ ID NO: 90 - DNA, 51193 bp, Homo sapiens
tggccggcagcaggggcaggagaaacagttctgatggtgtggcacagaggaaggggccccctgccagctgcagccagctgtgccactccctcagggggcagataaaggaaggccacccaggggagggaagacatctcactgatgctctttcgttccttcccagatcgaagaggttcctggtgagctcatgcaggaagacctggcaacggatgacgtcatgcttctggacacctgggaccaggtgggtgaaggacaggtgaaggctctctgtgccagagggagtgggagaaactagacttccagttctatgatcagttgctagaaggacctaaagggggcagtgccaggtgttgccagaaaagtctctaagggtactggaagtcacttcttctttctgagcttccatttcctcatctgtaaactgggagtggcggtacctcccttgcagatacactcaccttgaaagctgcaaaacgccctataaaggcaaatcacatgaccttcatcattctctcccagaccttgcaggagcgtgaactcttcctttaaatctgttggcagaggaagttgaacttagcagcatcttgtttgcaggcataaactgtccagtgtcacctagaggctctagagggctcctgcttctggtttgagggctctgggctctgtctccacttcatctcctagagaaggccattatgtaggacttggcaggggaagatgccattcacttactcaaccaatattaattgggcactgctttgtgccaggtgctttatgtttgagatgctgggatagagcaatgaataaagtaggcattttcctgctctcccagggcttacgttctcacaggggtgtcaggtcagtcacctttcctatcaaggtggcttctcccagagtcctcagagttacggagcagctggccacgaaggcataagactctacactacccacagggatgctcggaatccccagttggaagatcgggaccaaaaatgattgcagcttgagccattcagcagttgtcattgattgatccattggctacttaatctgtttgttcatctgttagggattcagtcagccaacatttattcagcaccatggtcttgcaggcaaaatgctgagtgctgagaatcctatgatgagcaaaatagaatgcctgccttcgaggggcttccactttagttgggaacacatttataaataagtaagagagggccagacatgttggctcacacttgtaaacccagcactttgagaggctgaggtgggcagatcacttgaggtcaggagttcaagaccagcctggccaacatggtgaaaccccatctctactaaaaatacaaaacaattagccaggcttggtggtgggtgcttataatcccacctacttgggaggtcgaggcagaagaatcacttgaacccaggaggcggaggttgcagtgagctgagatcatgccactgcactccagcctgggtgacagagtgagactccgtctcaaaaaaaagtgagaaaaatgaagtctgacattttattgtctaatgccattttatcaatgataggtgctctttgaagtaatattttagatatgcataaaaatagatgatacataaaaatcagctaaataatgtgtaatagaacttgtaacaagactcaaaatggtgatagtggtgggtgagttatttttattccaagccttaggcccattttgacaaagatgcacacagaccggcacatagtagactctcggtgcatatttgttggataaataaatgggtgagaatatgtttggccactcatttgttgaacgagtgaatgctgttcaagagataactcatggacctttagagaagaatctcaaactcaatgcctgatggtacctggttggcaatgttagcgaatgaagcaggctgggctggggagacgtgaaggagcagtggagtctgaggcaaactagaactgctcatctcaaaggggcagctcctgcgcagcttgactcaagtgaggtttgaaggcccaggctgctagatcctccaatttttaaagagaagttggaaatctagatttttatgtcataacggtttaaaaagacattgttggctaacacaaggtggtgggtgagcaaacaaaacatgtttgtaggttgccagttttcaacctctgttccaaatccttccagtcttagttcatgggctctgttagaaaggggagggctttgtctggtctgatacctggcccctccccagtcttcctccagccgtgaatttgatcagcactcctcatgtacctttcctgttgcatctcacctccaggtctttgtctgggttggaaaggattctcaagaagaagaaaagacagaagccttgacttctggtgaggacccgagtgcctgggggcggggggaggggtccgttgcttgtggggtgctgggagtggctcctgtacaggtctgggaatgagcatctttccaggggactgatggacaagatagggtggggacttcctcctctgtgggccagcccctcataaatcctgcctgggatagtgaagaacacatcagttccttcagaaaccctgaggcttctcaaagaaggctctcctctgttccaggagaaggaagggacagatgagaagtcacttcaagttcccagaatactcagaagctgaacttgtcaaggtttagatgtggcaaagcaggccaggcatggtgactcatgcatgtaatcccagcattttgggaggccaaggcaggaggatcacttgagcccaggagtttgaaagcagcccgggcaacatagtgaaacctcatctctagaaaaaatacaaaaaaattagccaggcgtgttggtgtacacccgtggtcccagctactcaggaggttgaggtcagaggattgcttgagcccaggagttcacggctgctgtgagccatgatcgcaccactatactgtagcctgggtgacagaatgagatggtgtctcaaaatgaaaaaaaaaaagaaaaagatgttgcaaagcagattcttggcagctgaatagatctgatttgtgagctgggaacccaaaagttggttcccatatcttccagtaggggactgcaagggaaagtaataagctttatgaagcaggagattaagccgtagccctgttccttcctgtgttcctgagcagggtggtggagagcccacgtgggtatcatgcctttaaaggaggatggtgcccagggcagggggtgggcagtagggacagtaggaccatagaccctcttctttgtcaactcctgtcctgagtcaccctctccctggtgtgggaggcactaagaattcctggggtttccttttcttgcacgtgtgtctgcagctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtgtactctagtgtggctcgtttccttgtgcccatctgacagtgagagccggcgtcttctctgcctgtgtccctggtaattctgagaatggccagagaggtgcctagcatttgcctgtaaactagtagaaaggctacatccaccctgtgcgtgaatcctggtgccctgagaggcgatgccacagtgagttgagaggtgtgtagattgtcctgggggatacctatgctaaaggaaataaggaggggccgggtacggtggctcacacatgtaatcccgacactttgggagaccgaggcaggcagatcacctgagatcaggagttcgagaccagcctggccaacatggtgaaagcctgcctctactaaaaataaaaaattagccaggcgtggtggcacatgcctgtaatcccacctactcgggaggctgagacaggagaatctcttgaacccaggaggcggatgttgcagtgagctgagattgcaccattgcactccagcctgggtgacagagcgagattctgtctcaaaagaaaggaaataggtggggaaccaaggaagactgggagagccatcagaccctcgacgcaagtctgaccctaggtggagaaaaaagggagagaaggttgtgcggaagtgtcttagtggtcatttatttaatccaggaagatttggcaaagcttgtcggcagtcccaaagccaaattcagtgttctttttaaatttaatggtatagtcccatttttgttgttttttattgtggcaaactgtacgtaacacagtatttattttaaccacttgtatgtatttcagtaacattgcatatacagtgttatgtagccatcaccactctctgtacccaaaactttttgataatccccaatataaatgctctgcccattaaataccaattccccattcttccctattcgccagcccctggtaacctgtattttactttcagtctcagaatttgactattccagggacctcatataagtggaatcatacaacatttgtcctctgtgtgtggcttatttcacttagcagaatgttttcaagactcatctgtgttgtagcatatatcaacttttcactcctttttgtggctgagtaatattctactgcatgtctataccacatctggtttattcagccatcaatggactctttgttatttgtgccttttggctattgtgcataaggctgctatgaacatgagcatctgttcaattcaaagtgttcttgagccagagtcaaagtcagccagcaaaggaattgtgtgtctcttgtaagcaggcgtgccttatctgccccctgcactcagtctttgggaggcctggccttgggacacatgtgggatgaagttcaaagccagcagtcggagcccttatcaattatatgccctgcagtagaaagcgggcagggtgcatcctcatagctgccacatcctgtagcagctgcttggaccttccctgctgcctctgtttcccacagattcattctgctgccccaaagctatgtggagaaataactgcagcagctgccagcacaagagctgcccccggatgctctcaaagtttgcggtcttcagggtatgggaaagggactcttctgtgccttcttggtcccctgggtcctgactctccactcatgctcagcatgtcacacagtccctcttggatatttctatgttgtttcataatcttttctcctgggagactaaaccagtccaagaaacctgctggaggacattccccagtcctcccgctctgtccttttggtctcttctcaccttgttttccccccgtcttgttctgtgtcacctcccaccaccactccatccccattgagttatgatgtgaaagctcgcaagcatatgactgtaaaagaacagaaaccagcatgagggcttaaatgatgggcaggctgtgtgtttgtgtgtgtgtgtgtgtgtgtgtgtgtgtgtgtgtgtgtgtgtgtgtttacactgttgtctccaaagctggctgatcacccaaattgcccagggaactttttaaaagcatggattccccaagggccattcctccagagattctgattcatcgcagaagtgtcgagggtagtggagaagaaattttctggatgaaacgtggagggaagatgaagtcactttcaggcagagggtgcagctagtacaggcagggggctgtgaggggaacagcgtgctcagggacagacagcagcctggagtggcaggcctctgagctgagaagcaggctggggctttgaatgccataccaagggtttggacttgatcccataacgcttgccttgcctacccccaaaggtttgctttcatggtcaaagcaatcaacttgacaaagtcctggtacagaagtggcatttaccacccaaagcttctagggctttcacgagaggcaggtagaggcctgtctagacagagctagcttacttcctagaaattagtgggaggtaaaatttcaggtagacctgcccattaattcttcatttcagtttataccagcattcaagggtatggctgtggcctcaaaagagagttgtgcaatgctctgagaaagaaaatagcctggggccactgagatgctgccttcttatttttctctcaaaggcagaaaagccaatcaggagcactatcacttcaaccgcacattttatctttctaaagttgcagacgtcatcgtctcctacaatggaaaaatcatcgtgaaataatgagacagatgccagagggacaacgctaggcttggatcttgtgtccaatcttgggcaattcagttgaacagatattttgtacttactttgtgcaaggcattatagatataatacttaaacttttggagcctcaagttacccacctgcaaaatggtaatgttgtattaatacctagctggaggtggtataatacagtggctaatagctggcttttggagtcagacctcagttcaaatctagctctaccactcattagcagtgtgatcttaagttctttgccatttccttagctgaaaaatgagaataagaacagtgtcaccccacttagaattctcatgaggattaagggaggtaatgcttagcacaatgtctggcctatagtaagtgctcgaaaatggttaaaaataatgaaagcacctaggccacagcagaacctagtattcaaccacggaggcaaaggcccaatgtactgtggatcagaaaggatgtttttggctgtaagcagtggagggctaactcaaaccaaattaaactgtaagcacacttatgtgctctcatacataatcagttcagagttgagggggacttcatggttgactaaacgtagtgggcctgagtttcctgctcattctcttggcccttgctagtctggtagtaaaatatctgtaggtgttctggttgctccacacccatgaacagcaatgcccagaggaaaagaggactgtttctagaaaagttttcagaaaagggaggaggaactgctcccaagaccacggaaaacctttcctcaggtctcaagaatccatattgggtcacataatcattcctgatggaatcatgggctagaaggatggaattattcataggccagttaggttcatcctagcaggtgggggtgaattcttctcctgaggtcagagcgctcagggggaggtatctgaacaaagtcatggctcctaggaaggagggaggagataaatggatgctgggtagaccgccattttgttggagacttctgggggccagatgcggaaaattaaaagtaatggctccttacagttctgtggcatccagtaattaattttcagactgttcaatttccagtcattttcccccggaatcttttagggaagatttgcagcctgcattatgattactatgtttctagagtttattgtaaaaccacagttttaacagcggcttcaatttcctttctcactaaactcttctggctacagggtagattgaaaggggctgtatcctattagccagtgtgactggtttaggcaaatcctagcttgatctgagcctgggtctgctgtagacctgatgttaacaacatcacaggaagagatcatcactaatatccccggagattttcctgtggcctggtcaacacagccaaatgagattatgcatggacatgaaaaaagctgtgtaaagtgtcttgcacagtgctggcattcaaccgtggttccttttgccttcttcttggttcctataaagtaaaaactcttcaggtaactgcatagctgtgtagttggatcttagacatgatctagcccaggatttcttaagtctttggataggtttgggagtggggccagtgtacccccaaagcatccaaatttgtgttgtgcacactatgtgcagttttcagacgaagctctgtagcttccaacacattctcaaaaggtctgagacccaaacagctggactataatctccctgttttacaggtgaggaaaatgaggctgagagaacatatgacttatccaaggtcacattataaagtggatgctatagcaaggaaagcactccagagcagtgattttcaaacagaaatatgtagaattctatgaggtgcttctgtgattttgtaaatattagattcaaattccatgtttaaagtggtaataaaaacagacaagcaaaatggagaaatcgaatgtagactctgaatataagattggaactctttcgtaactctaatattgtttttcaaaacagcctcattgttctcattgagttactttatattcagtaaatgttataaatgtgaactcaagaatttatcctggcaaaagacaccgtaaaccttttactgatgcagttacctttgaaaaaaggggtttgctgctgaaagtaagaggaagaggcacttgattcactatttactagccaagtaactgtgagagcaggtttgtgagtatcacaagaaatgatatattttaaaatgctacataagctgagagtctatggaacactggtttcctcctgctcaggacagtgtgttatgacatttgtggttacaaatgcccaatcgggccgggtgcagtggctcacacatgtaatcccagcactttgggaggccgaggtgggcagatcacctgaggtcaggagttcgagaccagcctggccaacatggtgaaaccccatctctactaaaaataaaaatacaaaaattagccgggcgtggtggcatgcgcctgtagtcccagctactcaggaggctgaggcaggagaatcgcttgaacccaggaggcagaggttgcagtgagccaagatcacgccattacactccagcctggatgacaagagcgagactccatctcaaagaaaaaaaaaaaacaaacaaatgcccaattgactctcctctttttatagtgaactttggctgaattggatggcccaaaacaaaagtttaagtttagggcccagttaggtgtgaatgtaaagacaaatgaactttgatagtcttgggaaaagttgtgatctatctacaaaatggtggtggtggtgtgtggatgggggcactagaggcaggcagtgtcacacgaagatacactgatacacctcacaaatctttggcattagacagatctgggtttgaatcccagctctgtttctttccgaccatgtgactttggctgttttaacctttgagccttcagtgtcctcatctacaaaatggtgataataaagtgtctatcaaaccattttgagataaaatgatagaatgtacatacacgtatttgtgcacagagctgagtgactggtgctcccaaatggtagccactaattcaagacagttctgtcagatgttgcaggtaaaacacattggttttttatcattatttgtttctttttaagtaaaggctatgtctatgtgattaactgggtgacagcaagaagtgggttcctgtcctgtttggaggaaggcaaaagaaaatgaagtcagttaaagctttgtggtggtggtggagggtgtgtgtggatcttgaaactccccagggaaaatgtgtgggccagtgcaccagagggtgcctggacctgggagacagcagatggcccacagcagcctgtccccttcccctggcccacaaagcacacgaagaagccaaccagccagctcagaaccggaggatctaatgtactacttctgaaaacggaaatccacagacattcaatacaggccgaaacagactctcaccccaaaaatattagtgaaagtgcatacactttattatgtacattgttggaaagggaggccacctggagaaacttctgcactggcactgtgttcctagagctccttctatgcgtccctcccaagtgatttaatttcagctgattggactacgaattcacaaggcagaaaagtcaaggtcatttggtatctggagacaggagaactcaaggaaccaaaagcactgttactctaagtctcagaaaaggttttcagtcaggatatggaggctcctggtcctcaagggtgaaccacttcacacaacagataaaaccatcattttaaaattcaaaatgtaagtgcaacttgagtttaagttgcactgctccatacctctaataaactcagctaggagccaggatacatggtagttcaaggcttcctaaaataagcttgaaattggggtacaggggaagggacatccattggctggatggacagagtggttgagctaaagagagctataaaggctcgtgctgggaaagaaagctgttatgcttagacttctctaggtgaactcagagtctcaaagaggaaatgttacaaatgtcacccgccagctttctggccagtaagcagaatgccaggttgctcagattcacagacatttgcaaaacagaagatgtctcctaatattatagactaagaatttgttgtccagaggagctgaccagttcctctttcagcatcaatatacatgatagaagaatgactaggtaaatttaaaaagacctacatctatatagatattgtaagtttgacagtatctgcccaagatcattagacactatatagtcaatatactgtgaattccttatactatgtaatgaatgggtttgtaatcaacatatttcacagtgtaccacagttaacagcatgcagatagtaaaatataatggtttcctgaagttatctcttaaaaaagtattttagtccttcagctattcaaatagatatataacaattgcatatagaacgtagagaaaattttattaaaaaattaaaactatttaaaacctgatatatgaaaataggcaacagtgagaaaaaagcacttttgtgacaaatatttagctggtttgaaagacagaacaaggaggaatcatttactcataaagaaggctcaaataagttaaaacatggatgtatttttaaaatgaccactctagtagtgaatttaaaagtcttttaagggttagagtaatctttttcattagtcttggctatttcctctagttctgacaagtacaggcaagaaaatggctactctcaagtaaggattattctgaaacacggtctggatttagaaaataaatgaacattagggaaatttccttaattaagactctccaaaccaggtgtggtagctcatgcctgtaatcccagcactttgggaggcagaggtgggtggatcacctgaggttaggagttcgtgactagcctggccaacatggtgaaaccccgtctctactaaaaaacaataataataatacaaaaattagctgggcatggtggcatgagcctgtaatcccagctactggggaggctgaggcaggagaatctcttgaacccaggaggcggaggttgcagtgagccgagatcatgctattgcactccagcctgggcaacaagagtgaaactccatctcagaaaaaaaaaaaaaaagactctctggaggtaaggcacatatgacctggagaagctggttgtggtgtaaggtcatcactttctgcaaagcatttagccagtcagcggtgtcaggtggcagttacagcccaggttcttgcctctggcctgggtgcttagggggttcagaatgagtcagtggaagtcaaaacaagagggatctaacctactacataataatctaaaaatacaaacttttaactattttaagactaacagattaccttatataaatcaccaatctctcagtatttacaagctaacaattctttcacctatttttataactgctatacattctgggaacaccacaattgacatatggaaaaagaaaagccctaccctctctttatgagttaaaggctaatttggtccccgacttcatgcttggaaggctagcgctcatctctacactagcctagatggctgtgttttgcccctatgattccttgcagcatatctatgggcagagggaagacaattgttgagtttttctcagcagcaatggtggtcagtgtctgcaggtatcggagctgaagggctgcaggagattcagtgatgaccatggaggcttctttcagagccctggatgcattcatttctccttcggctgcaataacctatggacaggtgaaaggaggggttgaactggagaaaacctcatggggacacacagcactcttcaaccgggggtatgtatacctcaggtggtccacaaaactttctagggcgtatgccagagtagttttaagaaaatcaatttctacatactcagtttccatatgcttctttttctgaaactgacttgcctgactagtgcctggatcaagacattctcttttactatagcctttctcccattttccagggtaacaaacaaagggataattcaaaatactgtgcaggattgagaaagcaagtaactttaatgactgcaggcaaatccttttgcaagtcagcagcatttccaattctctgatgagtaccttactaaactgaaagctgacaggtcattataaatattttttgatgaaagactgtgatatgatttttttagcacataaattcaaagtgctaagaactgtatgatactactttaaacagaacttccatttccatctacttatttatgtaaataaggtttcaaagtccttatagctataaaaatgaaaaataggaataaaattgatgctgaatcgtgtctcattctagcattaaacaacagccatctatacatgtacgatttaattctcattcatcttataaagacaagcatttctagtaaaaattgacttctggtactgggtgcagtggctcacacctgtaatcccaaaactttgggaggccaaggcgggcagatcacttgaggtcaggagttcgagaccagcctggccaacatggcaaaaccctatctctactaaaagtacaaaaattagctgggcgttgtggcaagcacctgtaaacccagctacttgggaggctgagacaggagaattgctcgaacccgggaggttgcagtgagccgagatcatgccactgctgcactccagcttggctgacagaatgagaatctgtctcaaaaaaaaaaaaaaaaattgacttcttatttaggagaaattctgaaatgtttgtagaaccttgtttttagttacaggaaatttttaaaaattaattctaacttatggactaaatatgttgcagtatgttaataaaataattcatgacaaaatgtatgttaggaaaagaatctggcggaagtgaagatgcaataaaaaacttaggtttaagaagaagaagaaaaaaacaataaaaagctcctgactgttaagagtttacttacatatttttaatggataactaaatcattattatttctcattgggtacatttaaaagaatgatgttaacagttttatttaaaaatgtcaatatttacaacatgccaggaattatattcttggcaagtacataaattcaagatgaaaaatttttacatgccgatttaaaatgtttgatggactttatagtttttctaaattctgtaaggggtttcacaggcaaaaaagtttgaagatcactcgagtagtagacagaacaggagttctggagtcaaatggacttgagttcaaatcccaaatctaacatttaccagccgaatgtcctcagagaggttactgaacatcctgaacctcagtttcccattcttaaagcagactaacatgtacttcagaggaccacttgtgaggaagacagagaaagtatataaagtgttaaatgaataaagggggctattatagaggaatggcaagtgacaagacctgatttttgggtccaactatgctttaatgcacaaaagattcaaggtagttactttaattcataatcctagaagaaggaaaggtattaagacaccataattatcaagattaaaagtacaatttctccaggttattatcctcacttgaatcttgaataattaatggtccataatactccatgaatatcagaattggaggtgatggtcttatgcccagtgagatttcattcactcacacagcaaaatttgggggccttctagggttaataagccctgtgtaggaaaagctaaggatagagtggaatccctagccttcttcagctcctggtcaggtagggaaggcagacatggaagtagatcatttcattctagtgtgataaatgctgacagacatatgtacaaggcacagtgcaagcaaacagaagaaagcaacttttccagagggtgacgtggtgaggttatagaagttgaatattaaatgataaaatgtttgctgtttagaaaaagatgaggaagaatattttgggcagaacacatgaaacggtactgaggtataaaaatggtatattccagaaaactgtcaatggctgaatactatggcaggaagaggggaaaggtgggggatgaatggggccgggttctgaagggcagtgagggccagggtgtttggtcttcattctgtaggcaatgggaagctgcagaatgattttaagcaggtaagtaaactccatcagatctagtttgaaaaagctctctgacagatgtctgaggttagaagagaaggcagtgaaagctgctagtggaactgctttagagtggccggtgcgattcataggtggtggggacagagaatgaaatggtttggggagctattctccctccccgaaggagggcgaatcagtggaatttggagactaggtaggaggaggaaagggggacacaggctgagacccaggtttccaggttttggttgcatagattagtgccattaatggagataggatacagaatatagtactcactgagagaaaggatccagcttataggataaaaaccttaatttatcaaagccacacatcatgtcctgcctaggtctgtgagaagggacaagtgccagctttgctcaaagaaaaccacagaactgtattccaaggtaggcactacagagaatacatcagaaatcccctgctatgagagcagcaggctctcattttttccatatcatctcagatgtccaattaggcacttttttctttggacatggaccaactgaaaagatatctcatttcccaccaccaatcaatacacaatcgcttggctgagaagccagacccaccgggctgggcacacattttgttcatagaaaagccacactgagcaagctgccaaagatgtaaacaacaccaccggctttgtctaaatacaggccaagtacactccgttgataggatcttagagagcaaagcaagctatttgtgggtgtgcacggcttttgtcgaatgtgcagtaatctcatagcaatcaacatttcatatttatagaacatcattttaaagtctggcattttcatgtatgtgaaattggtgctacctgtcccttctgcagaccaggtggtctgggcagaggaaaaggcagagaaaggtgatctgtatttctgcactccatcctctcaattaatagacttctacacccagaaacatgagcccaaaagcatgtgccaggtgtttttctgagagttatgaaaaggaaataaaagctgatgcaaacacaaaagatattacatttcaggccactaagagctggtctaaacactttaaaaaccaaacctaacatacagagaaacacgtaggagaatctgtcctcttctgtgaccggcttctttcactcaaattatgtgtgtgagcacttacattcattctctttgctatgtagtatgcctacatgtgaataaaccagacttcattcattcagctaggaatggacatttgggtattctacagtttgggtcaatgtgctgctgtgaacattctagtacatgccttttggtaaacatatgagtgcatttctgttagattcatacttaggagttggagctgctggctcatagggtatacaaatgttcagtatgaatagacattgccagactgttttccacagtggttgtattaagttacactgccaccagcagaatatgagagttctagttcctctctcacccacacttggttcttttccgttcttttcaggccattctgatagctgtctagtgtgacatccgcttataatgtgaatttgcatttccccgatggctaattagcctaaggaatttttctataaagtctcttaatctttagattattccactctatctcacctttcctgtgcaatttatttgttgaagaaactgtgacccccctattttccatgagaatttcaatacaataagcctatggttgttgcagggttactgtattttacagaagggctaggctcattgtgattctatgtgtgaactccaagacagtcactgcccaggttcatgagactgcttctagactaaccctacagccccgtccaagtgggagcatggcaattcagaattctaagcggtttcttctatcttttcttactgttataaagggaagatagaaattttctttccaaactcttaagaatgctatggaagaggctcatagcccatcctgggaagtcagtactagaggaggcaatgaggagcagaggggaattctaatttccactgctactaatcaactgtgcgaccttgcggacgtcacttaacttttcagagcttcaatttttcctttgaatagtgggatggcaaacaagtttcatttttttttaagtttttattattattaattttttatttaatttaatttttttgagaagaagtcttgctctgtcgcctgggctgaagtgcagtggcgcaatctcagctcactgcaacctccacctccagggttcaagcaattctccttctcagcctccccagtagctgggattacaggcgcctaccaccacaccaggctactctttgtatttttagtaaggacggggtttcaccatggtggccaggctggtcttgaactcctcacctcaggtgatccacccacctcagcctcccaaagtgctgggattacagacgtgagccactgtgcttggcctcaagttttgttttttagagctaactctaagcagttgagggttgttacccagagtgctatagaagggttctgaggccaagtctaagctcagaggaaaacagtgctgtggttaattactagcatgggaatagcaggatggagtgctagcatctgggctaagtgtttgccacctatggaagataatctctgaggatcctttgggctctgacattctacgtagtatatgtatggtacattctactattcaatctggtttggaaatgaggcttttgcctaataacatattctagttaaaagcaattcctaattttcaaaataaggagatgatagggcacatttaataacatcgtaaacataatttaatcttctaaacgtaacagttttgaaagaaagcactagagggttctgtagtactaccaggttatcatcacaaagcaacaatcatcataccaggaaaacctaaacattttggttaatgcaaaattctgaagtcgcatgtcaaatgagctactatcctatttgatgctggctaagaaattatagtgaccagtttgtggcttaaagggcatcctaagaaaagaacagcgttctgtggtcagccagtgatgaccagctactactattttctaacaacaaattggtttgctccttgtgtcttgggagatttgtcaagtccacagcaactcctcctatgaaaactgctcttcttcttcagcccattcacaggcatagggctgtggaaccatattattatgctatctttgcactttgaccaaagttggaccaaaaagactgtctcttctgtgaatgtggaattagggctggtctgtgttctttagtgttcacctggcagacatctaaacctgggagctagacattctccaccacaagctatctacagtgagatgtggcacaggaaagggaatgactagttccctgaactgccttctggttccaattttggtgagacttgcccctacttcctacctttgggtttggtgagatatccctgaaattttacacattatcatctttaaagatactcttttctaggttaggttaacaaatatttcctcagtgcctcccagaggggccatgccacccatgcagggttaagacataggcagatgatgatgaaaagaaggaagaaaaaaggcagatgtcaaagtaagagaatataaacaagaggaaaagagagaatgaggaataggaaacagtaaaagggaaaaagagcctgagaaaagaaacagaacaaaaaagaagccaaaaataagtaagagatgggtggtatggatggaatgatgacccacttgctccgaagttggaactgttaatttgaccttaatatggaatcgggagaataagtatggtacacacagtcataaaagaatgaggtaactctacatgtactgatacgtccatagatattaatattaaatgaaaaaagcagagcgcagaacaacatgtgcagtataaccctacttttgtaaaacaaacaagccagtaatccaaaaacctggtcaaataaaatccaaatacactcaactgttaggagtggtgacctctgggggaatatgatttgaagttacggggagggttttcacttctaactttaccacttcaagattatttcaagtttttacagcaagcatgttttacgtttttttataattattaataaaagagaaaactcagtaagaaaaacaagtttaaaaaaaaagttaccttggcgcgggcctcgcgggacgcttctgcttctgcagccatagctctctggagctgcacaggtagtttcacatccttaatttccacacgctccacctttattccccaggcatcagtggcatcatccagagtagactgttaggaagagagaaggcaagctaaatctcctcagcccagcccagatgctgacagaggctgtattcattgggatttggaggagataaggtgctggggagagttgtggagagacagttaccccacggtggaacgaatggtgacgcaggggctggctcactgatcctgattctgttgctaacaagctaatgcaggggttagcagcttcttctaaaagggccatatagtgattgtttatttgtagtctctgtctcaactatttaacccagctgttgtagtcaaaagcagccatggataatatataaataaatggctgtggctatactccagtcaaactttacttacaaaaactacagcctgtaggctacagtttgccaactcctgagctaatgtgactctgtgtaagtcatattactcctttgtgcttcaacttcctccctttagaatgtcaggaatgaaaccacacatctatttcataggttgttgtgcatatcaaatacaatcatagattttacccacgatgaagtctatacaaataataagaatccagagttatagcactttatcttttttgaataagctatgcttaactgaatatctgttactcaagaaagactggaaagcacaacagttataattcatgggactcacacacagaataaagctttaggaatacctacactatcttgcagaatagcctctgttctaaacaaaaaggttattactgattctggaaaaaaatacacactgaagaaaattttaaaaaaatgtacgcatgagtgttatgaactcatgaactgctaatgtgaaaaatgtcccctcctgccaaatttgaaaaattttactatgaagaaaaaaaaacggtcacagacccccacaacttgaattaataaaaggttctcaaacaaccattgactctttgcttcatttttcagcttctggggggtaacagcattgacgtactccccacctgcatgttgtgtgcaatttcttctctgtcagagaggatctgagaaagattcttggtgcccagaacattcctcagagtagtttgtgccaaaagacgggttgctgagtcagcgttggtgatatttgccacagccagggttgcattctgaacgcggtaatagaccacaccatccacgctaattgtcactgaatcctttgtgaggatctacaagatgaaggaagcaattttacatctgtcaacgacttttttttaacataactgtaaggaatgttattctacagaatatcttataacactagctgattttctttagtaaggcatcagaaagttaattatatcttttaaaatttaataaaataaattattcaagtccattaattcattcaatcatacaaataatattgagatatcactcaacagcaggcactgtactaggtaccagggattaaggtaggaaaaaaacttggttcctcctttgaaggaggttagggaatcaaaggaaactcttaggggcagctgtgggtggcaggggtgatacctgaattgaatcttgaagaaaggaatacaatttttctgagggtgttgggtggagtggaagaatattcaagagagaggcactagagagtcaaggtttgataaactacaagttccacaatattactggaacaaaaagtgcatggggaatgtttttaaagggcaaggtcagcatcaaaacatattttacagcatgctacataaaaatgctaaacatgacatatttttgttttaagctaagaagttatctgagtgagaggctccaggaaaatagttacatccatcacttaaaactcactgggactcagttttctcatttgtaaagtagagattaattatagtacctactttgcattcttgctagaattaatgcgttaaatacattcaagtgctcagaaaagttcctggcacgtaagagctgtcttattatttcatcttggataatggtggtaactttactgaataaaacactgacttgattaactgtaataagttaatttagataataataaacaagccagctgggcatgatggcatacacctgtagtttcagccactcaggaggctgaggcaggaagattgctccagcctgggaattccagcctctctcactaacaacatcaggctggcacctttctactgatcatttaaatgtccttctctctgtgaaactttcttggcttacttggcagagttaagcactcttcccttgcacatccactgcaccttactgtagtgacattatttattcacatttctacttctctcttagactatgaatttcttcagggcaattctttgtaactctaacactggcagagtgcttgaaacatagcgggtagtcaataaatgagagaggagctgaactgaaatgtggtcctgagaacagtgaccgatgaggaacacagcagtgagagttaggagacctgaactgagtcccatctctgccttcaggtccctggatggcctctagcaaggtttttaacccatttgaccaacagattcctcatttgtgagatggcgctaataatactgcctaattctatccaaatttctgtgaagatcaaataagaacatacttgtgaatgaagcccttttgaaagagtaaacagctatgaaaatggaaggtaataataacaatgttgtaacatggctgtttagccctgccagacatcaaagcagtgatccttttttagtaatctcaaaatacttctaacatggaagagaagtggaggatttataaataaatgtacagtgtattaccatcttgtatgaaaactaattatttcccatgacatgatgggaaaatgtgtgtcattcccaaattcttgccactttgactttgccacagcttctttctaaagctacagcttctctgcctactgtttatcatcggcaagggtttatctcccttcacagaaacttcacaggggatcagaaaaaggattgctgccaagttccaatctgctttgcattcagcagcttgcagaataggagagggccactggaaagcagaagcttaaacagcaactctgccagatgtctgtaatgtttatagtggaaaatgccagaatgtccagctaccctgaagggctccttctgagactcaatcttccttagacgatgggaaaacacacagagaatacagtgatactctcagtcttgttcttatgagtaaaatgtgggcaaaatgattcctggcatcactaactttgggtggattataaagtctgaccccacccacttcttggatcagtaccaacaaggaagttcctaagctggtttctggtatttgtgacatgagaaggcaacatggccaggctccatcaccatgctgagtatctggcctttggccaggaaacactgacagcattcttctgtccttcccccttcatgatgttttcaggttttctgtatgcaacggttattaagtctcctaaggacatggttcccaggatggccatcactttttcgggggctatgagggagctcatgtacaatgcatttagcatggagctgtggaaaaaacagcactatacaaagaatccgaagagctcaattttagtcttggctctgccactgtaatctggaggaattcctttgtttcactgcaactatatactttctagggattctgccatgagtttcatctatgataatacttgtgaagtagtttgaaaaggcacaaaataatcactagtataaaatattatgttttatctaaaatgcccaacaagcagtttctaattctttggtttctaaccaatttatctagaataaaaccttaagaaaaaaaataatgaactaatagggttttctatcagaaacccatagaagagaaatgtggtagtaaaaatgttgatagtaataacaatgatgatattattatacttacattagcattacactatgttttgtaataatcattcctcggtatctgtgggagattgattctaggaccctcagaggataccaaaatccaaggatgctcaagtctcttatatacagtggcacaatatttgcatataacttatgcacatcctcctttatacattaaatcctttctgaagtacttataatacttaacacaatgtaaatactacataaatagttgctatactacaccgtttttaaaaatttgtattattgtatcattgtcaattgcttttttccctaaatatttttgatccatggagccaaccgtataatctatgtacattttcctgtacactttaaatcatctctagattacttctattatccaatacaatacctacacatcactttattcatgtggattcaatgccatgcttgatgcatggcaaattcaagttttgctttttggaactttgtggagttttttcctaatattttcagtctgcggttggctgaatccctgtatgcaaaacccatgcatgcaaagggccaactgtaatagtaacagtaagaacttatatagcacttactatttgtcagccattgctctaagcacttggcacatatatctcacttctcagaaccaccttatacagtagttcttactattacaaatgtctattttctggatgaggaaactgaggcacagaaaagttaaagaacttgcttaaggtcactgagctagaaatgctgaaggcagtcaaggtctaaagcctgtgctctggcagggaacggtggctcatgcctgtaatcccagcactttaggaggccagaacggatcacctgaggtcaggagttcgagaccagcctggccaacatggcaaaatcccgtgtctactaaaaatacaaaaaaattagccgggcgtggtggcgcacatctatagtctcagctactcgggaggctgaggcacgagaatcacttgaacccaggcggcggaggttgcagtgagctgagatcacactactgcacttcagcctgggtgacagagcaagattccaattaaaacaaacaaacaaacaaacaaaaatttaaaataaataaataaataaagcctacactctaactattctgtccctcattgtaaagcactttcacatatgatacctcagttattcaaagaaaaccttacctcctgaggaggaatatcaaatgaaatagttctcatgtccactttgatgaagctgtcagtgcatggcagaataaaaaacaaacctgcaacaaagatacacacattatacagacaccagcaacctaatcagttcacttctccattcagttttaagaaaatcaacctagtgaactgaaaagtcaccagttcatcttcgtgaatgagccagaagccaggaatgataactttgattcctcttgcttacttcccacatttgactgtctccactaaggtctgtggagttcatttccttaatctactgttgctatcactcttctccccaccgccccactgggaccaatgcaatcgtttcccaggccatctttctattttttgtagtttctctcctataatctatttcctaagctgcaagccgagcaatcccccctaaaatacaaaccctcccccacgcatggtcctgcataacccgcctttgttcccctcttcagccacttcctctctcttcacaccctgcactcttgctggactgatctacttgcagtttcttgaatctgcaatactctcctctttgttgctttgtgtatgttgctatttccgccgcaaacacctcctgttggttaacaccttttcagacctcaagactcagtcaagatgtaacttccagaaagccttgactcagcctacgactagttcagatcagtaacacttctctggttttctcttttctcacagctctctgtgagtacttgatcataatacttatcacataggattgtagctatctgtttccttgttggttcctaccactagataggaagatccttgagggtagggactgtgttttagtctcccttgaattcccagaacctggaacacagtaggagcttaattgaagtttgccaaatgaatgactgaaagtctttctttggtagagattctcatgctcaaacttgtatagctgtactgttcttggcctaggtggtaatcttatcagctcaaatgggaaggggaggggaagggtaggaaggaaagggtaacaaaagattggctagaaccactgctattgttatacaactcctgctacatgaactcttatctaagacagagtagaagaggccctcataagggaaatcacgtcaataaaaaaattttagactgggcacggtggctcacgtctgtaatcctagtgctttgggaagctggggtgggatgattgcttgaggtcaggagttcaaggctgcagtgagacatgagcatgccactgtactccagcctgggcgacggaatgaaaccctgtctttaaaaaaacaactacctaaaaataaaaaaaataaaaagaactttagttttcagataaacaatctagaatcccagtactgaccaggtcctttggctcctccttgtaaaatgcgacccaatctaaagatgatggctctttcatactcttttataatctagaataaaaacatgaataataatttaacatgaagagtacaaatatatacatgcatggcttcttaaatatatatttctgctctaaacagattagatgcctcatcttttttctttagaaccagatcatatctataaatcacatgtccaatgtttaccttctcaaagcttatttattattttcttactgattacaaaagcaatagatattcactgtataaatttaggaaggacagaatagtatacagaaacaaatccataacctcactcctcagctgttaacattgttattcagttactcatgcaggccaggcacggtggctcacgcctgtaatttcagcattttggaaggccgaggtgggcagatcacggaggttaggagttcaagaccagcctggccaacatggtgaaaccctgtttctactaaaaatacaaaaattatccgggtatggtggtgggtgcctataatccaagctacaagggaggatgagacaggagaatcacttgaaccgagatcgcaccactgcactccagcctgggccacaaggtgactccgtctcaaaaaaaaaaaaaaaaaaataataataataataataatcccagctacacgggaggctgaggcagaagaatcgcttgaacctgggaggcggaggttgcagtgagccgagatcgcgccactgcactccagcctgggcgacagagcaaggctctggctcaaaaaaaaaaaaaaaaattactcatgcattgttaattcagaaacacaaaaagctgaagtcttcacagtttttcttctgattcccttaagaataaattgatctgaaaatgcttggagcatattttatcttcttagaaatatgtaaataatagtcatatatcaaagtattaacaactttgtagaaaaaataacgagcactgagggtatttatgacgtgccaggcattgtgataagtacatttagacacataattcatttaatcctcgcaacactcctatgaagtaggtactgttactttctcccattttacaggtgaggaaacagcaaaggtcacacaataaacagtaaagccagcagtcaaaccctatcatcctaactctgaagaacttgttctctcagaaccatctcacatccctggccccaggaaatttttgatggtgaaacttactttagcccacggggaagggcaatggctgaaaagaagttttaaggttccattttaataggtgggtagaagaataaattttccaaagaaagatgaagaaataagaattataagagagagagacagtctgtttctttctcacatacacacaggcacacacgaagtaggtttatggaggtaggagttgaccccttcccagaagtgaatgaaatgttctttacctttatgcacatccatattgagattgggaaagttataacggtgaataagaatgagaacgccaccaaaatccatccgcaaggtccaaggcccttactggggctgtctgttgaaaacaaaaaatatacaactctcacaactgttactagcataatcaccaccatcttcatccttaccattcgctgaatacctatgtgcttggcactacaccagctgttttacatgaatttccccatctaatcctcatacagccctgaagtgtaagtactactttcccttatctatgtgatgtcataacacaagtatatttccacattactcattactttattcagcaaacatttattaagcatctactatttattaggccctctgctttgtactgaaatgataacaatgagtaagacccaatcccagctttcagggttaaagtttagtgggaaagtcagacaaacacataattataatattaggtggtaagtacagatatagagtatctgttcagaatattttgaagacacagaatgagttaactcacgcagttaggatggaggtgagaaaggaatggggcggggaggtgattcaggtggctgtcagagggtttcctgaaggatgtaatagtaagaaaatatcgacgaaaagaaagtggaggctgggcgtcgtggctcacgcctgtaatcccagcactttgggaggccgagacaggtggatcacttgaggtcaagagttcaagaccagcctgatcaacatgataaaaccccgtctctactaaaaatacaaaaattagctaggcgttgtggtgagtgcctgtaatcccagctactgggaaggctgaggcaggagaattgcatgaacccaggaggtggaggttgcagtgagccaagattgtaccactgcactccagcctgggcaacagaggaagaatctgtcaaaagaaaagaaaagaaaagaaaaaggaaagagggaaaaggcattagagcattttagctaggagtacagtacgaataaaggtgaaaaccatatgatatgagtataaagttgtttagagcctctttttaaaaattacacctgtaaaatatttcactaggtttatgcagcatcatttattgcccacttcctgattacacaggttgtttgatttcttagtgctataaacagtgttgtagtgaacatctttgtacacggctttcctctcacatttctaattgtttcctgttcctgtaatatgcaacagcttttccgtctgattacaaaggtaataatgcaaaaaattcacagaagtataacaaaggagggaaaaattactttaaattcagaggtattttggtatattctttgaaaattttcctagtgtacacaccatatttttaaatgatatatatatatatatttatttatttattttttgagacagagtcttgctctgttgcccaggctggagtgcagcagcacagtctcacctcactgcaacctccacctcctgggatcatgcgattctcccgtctcaatctcctgagtagctgggattacagccacctgccaccacacccggctactttttgtatttagtacagatggggtttcaccatgttggccaggctggcctcgaactcctgacgtcaagtgatctgcccaccatggccttccaaagtgctgggattacaggcataagccactgcgcccggccttaaatcatatttttaaaaataaataaataaataaaatgtgtaacctatttttcttccctgtagctattctctttcaccttcttttttggccttcgtggttatgcatttgtgtttttgaagttacacttgcataaagtttaaaaagtcaaaccattctatatgattagtacaaaaaaagggcattcccatgctcacctcttccaatttcctcctcctcaaaaacatttgctattttgaccattttgatatctacctccatatttctaaataatacgctttgcagctgggtgcaggggtcacacctgtaatcccagcactttgggaggctgaggagggaggatcccttgagcccaggggtttgagactagcttgggcaacatagggagactctgtctctactttaaaaaaaaaaaaaataataataataatatgcttctgccaggcatggtggctcacgcctgtaatcccagcactttgggaggccgagatgggaggattgcttgagctcaggagtttgagaccagcatgggcaacctagtgagactcccatctctacttgaaacttcttaaaaaaaattagctgtgtgtggtggcacacacctgtagtcccagctactgaggagactgaaatagggggattgcttgagcctgggggttcgtggctgcagtgagctgtgatgtaccccagcctggacaacaaagtgaggaaagaaagaaagaaagaaaaggaaggaaggaaggaaggaaatgcttgttttgttacttcttgctttttcagttttgaggactattaactttctactacagaaaaagatttagttctctttcctccccgttacccccaccacatacttatacccagctttccaatataattacatcataacttcatttagatcaatatgagattttatattatgaatttgtaagtgcaatttaaagctaagccaagtagtgaggtatcactggttttctcttcctgtactatttttgttttttctggaattactgtcttattttttccctttgttcggttttcaacgtacttattgatccaaccttaaatcaattgcctaaatttcctctcaaagaggtcaggtatactatcaattttatcttctggaagaattctctctcagagccttgtgtggacttccttcatctggtgtgcacggctatcattctgcaattgctttcactatcatcctgggaactcccatcacctcagtgttgtgttcctattttctgtatcaagtgtcatcctcatttttagtttgcttttgctttctgtagaggacatagggactgagaaggccaagggatatagtaggttttcttatcaaccacttggaaggcttctgctgtattttcaggagctattttaatgacagaggggagaaaaggtatgccaggcacatgttactgctcagaagaaagggcaaaatggcagtaagatggggcttggaataaataggaggccaagaaataagcagagtgttcaggctgggaacatgggagaagagagacacatgttggcacccaggtcaagtgctctaaaacataggatgaaaaatcagaaatatagtgagtacttgggttgtatgtgacttggtagttttctgatcctgtgttatagtgtgaggtaaatgtcttcatgtatacttaaataaaatgatctaaagtaatcctggaggtttctaagttataatttagggggtacagacatattcattgagagaatattcaaagcagggccatagtactgtttgtgaagaaagctttatctagtattaccatgactgatcatagcaacagtggctgttttgaggggttgtgtataccccaggcattttttaaagttactttagacatgtatctcatttaactcttacaacagccctgtgagggtatttttaaatcccttttacaaatgagttacctaaagcaacatttaactttcccaaagtcacacaatggaagacctgggactcaaatatgggtcatcttactccaaagcccgtgttccaaattcacccctcaataaaaaaaatcctcattaagaatgttttcgtggttgagcactttctcaagacagtatccaaactgaaaagcatggctggagttgtgagaatgaaatctgatatttttacagaggaagtcctcttaatgccagccatgcctatttatagcaaaagatagtttcaaggctctgtgacagacacaggtctaggtttccagggtgaaatgaattccaaacaaggacagactgaccacaaatacttatttatctgacagcatttggtgccttttcaaatactgtccaagtctcccataacatactagagtaaaaactccctgagggcagggatgttgcttattcacttttatattctcaatgtctagcacagtatcctgcatagtagaatagatataaaataaaatacttctcagcaagttttctagctagatatgtctttttctttcctttgaatctcgatagcattttttgaaaattatcttatggcacttatatcttgtctaatcttttattttttatttatttttaattgaccttccaatgtaggattttaatcttttattattttttaatctaatattttaatttcttgtgcatttatatcccttattacactgagattccctgagaacgaggagtaactatgtttgaatttcacttctgatacttcttagttgcatgatctttacctctttgaaccttagtttccttaccggtggaaagtaaagattattaggctggccttgtagaatacagataaaatgatcagtaaatgtagatgatagttttctgtaatccttctattttacttaagtgtttgtatcttcatgaagaaaaatgggaaaatagcatttaccctttttgatcaaaagcctcttaaacaatttaatttgccatttgcttcatacctgcccccagtctggctaggctgggacattcaaagactctcaaaaagttcatttatgatctacatgaggacaagccaaaaagttcagcccagttttttttgtgtcagttcccatgtcacattgtgtttttgagaaccccagatgtgtatatgggattgcaaatcaccaggaacaaggaattaagtacacattttgaaaactggatttggtctttcacatatcaaatgcttggctagaaataatcagtgtatacactgggaaaatggcactttcatatttttctaatgactttaaaatgaaagtatcctaccttcacctctcaaaattcttccccacctggttacccctcaaaaaggtacacagtatctaagttgggaatgcatcactagagttctgagactgaaatctgatgtttttacagaggaagccctcttaattccagctgtgtctatttatagcatgttgtgctataaatgcatagctcagaggtgaggcttaaactctagcaggcttataaatgaacccttagtcatctaccacttctgggaataagagaaaagaaattctcactcactaaaatctcaggaaattcatttccttcaagtttcccatgtattactttaggactgaatccttcctaccagttttatggggaaagggacaaatagtgatattttggttaatacacttgtggactttttttttttttttttttttttttttagatgtaatctcactctgtcgcccaggctggagtgcagtggcgagatctcggctcactgcaagctctgccccctgggttcacgccattctcttgcctcagcctccccagtagctgggactacaggtgcccaccaccatgcctggctaattttttgtatttttagtagagacggagtttcaccgtgttagccaggatggtcttgatctcctgacctcgtgatcctccggcctcggcctcccaaagtgctgggattacaggcgtgagccaatgcacccggccacttgtgggtattttgctggttgagaatgttcctaaaaattagggatcctatgatacttggttgtaaatactactttgccatagtttagagcaatggtccccaacctttttggcaccagggaccagtttcgtggaagacaatttttccacaggaaagggttggggaacatggttttgggatgaaactgttccaccacagatcatcagacattaggttctcataaggaatacacaacctagatccctcatatgtgcagttcacaatagggtttgtgctcttatgagaatctaatgttgctgatctgatccgtctgtggcctgggagttggggactcctggtttagagtatttttttttcttttattaccaaaatggcagtagaataaacttttaactaatcaaagaagggtctgaatatggacataagcctgtacatttgaatttttgtattgaacattcaagttgggcttacctccaggaaactcacatacattttctaaaattgcttttttactttaaaagcaaaagttactataaaaattagaaatgatagctcaacaaacagaaacattatctatactttatctctggatgttttttgccttgatatacgtcttttaaaccttttctagcctgtattttttcaataatgaaagaatggtatacacagtgatttaaaatcttctccctcccatccatgttatgaacattttttcatatcagcacatattctttatcattattaaagattaattaattaattccattttatatgatgaaatctgttgtgtccaaatttctcacttagaaactgctgcattgaatatatatttagcagtgtttctgtacctgcttatttcctgtgtaagttaatttttctgaaaagatgaaattatacaactcttaaaattctctcattctgaaggtatcttttgttactactcctaataactaccatttatgaattcctatgacatgttagccacatgtagctcctccttacatacatgagtatttataatgtttacaaaaatctgtgaagtaggtgttaaaatatgcctcctgaagttctaaagtaataaggctaaagaccttgtaggaagaaacaaaagaaaaccaagcaaaccatgaaacaaatgaaatttgttgtgtagtaatttttgttgggtaagtttctggaaaggcagttaaacattctttccaagatgacaacacaggctgattagtccagagggctgtagttgtccccgttccccatcagctgatttactttcagatctattaaccttagcactactggaaatcatgtggagtaataaatccactcatcactgagattttattattgtaaagttcaacagataactggatttcctctgctgagaatctgactgtgagtcataagcattatcctacacaataagaaaggatgggctaaggaattactgaaatacctaaactgccactttttaacggacacttttttccttctgccttcacagagtgcaaataaaacacttcatgttgtaaattgatgagagcagtcctgcctggatggggcaagacagaaaggctggaagtttagtctcaaaaacacatgctattcagttgcagcagcactttttaggggtaacagtaggccaaattgaaaagtcttggcaatttttgaactttcttcttaaaaacatatgtattcaggattaagtgttacttttggccactatgattcttcatcagtgattctttgtcaggattggcaaacttttcctgtaaagaaccaggaactaaatattttgggctttgcagtctgttgcaactactcaactctacttttgcagtgcaaaagaagccatagatagtacctacataaacagcacagctgttccaataaaacttatggacataaatctgaatttcacataattttcatgtgtaatgaaaaagtattcttttgcctttttaaaatcatttaaaaatataagagctatttcataacttgtgggacatacagaaacagagtcagctagatttggacaatgggctgttacacgctgttcctgttttatgtcagccaactatttatttgaggaggaagacttgcataaattaaataatgcatttgatctttcttccagctattcaaataagggtacatttcccagcttctcagtttctcccttttgcttattttgaagcaaggcctttataaggcctgataaacaaaaactcctggtgaaaataagcaaaagggcaggtagagtaagtgaatataaattcctcttcaattaatcaaatttttactataactaagtttttcaaatgactggaattttaggagaaaaagacaaagaagggaaggacatagcagaagcgaaggaaaataagagaaatagaaggagtaaaaatgggagaaacaaaaatgaagacagaatcctacaaagagagatagattaaaaaagctagaagtgagaaagaggcagagtttaccacatggtagcgtctcgataaacgtatgttaaaaaatgatagtgtttcattagagatcaaaacttgcaattcatttaaggcagaagatttcaaagcaaacaagcacacacacattatagcctgcctttcaaattagtattttaattaggcacggcttagttgttcgaatgcccttatccttaaatctctagagaagaaattattcttggggctagagtagctacaggccagatggtatcaagttaaaaaccatgagtgaagactgtaacttttcctccctattaaaatccatctatagttataaatgctagaccaaaagaactgatactgatgaagcactatgtggtttgaattacaaagcttaaaatgtgtttactgtgaaatactaaggaaaacaaatggactaatacttctaagaaagatttgcaataacagttattctttgcttagctcaaaaagaataaggaaagtaaataagcataaatgtcttatttcctaaatattttaaggattttctgtagttttcctgcattcaaatgtttcaggccatacaagaggaaaaaaataggtgagagcaacagcaataattttaaatttggacctctcagtctaaaataatgctgcaatagccctttacccttttaaaacaacatttatcacacttgtaattattctattcagttgtgtgtcttcatgagattttggttttatgaaaacagtatagcataataggttcacagatggctctgccacttactagctgtgtgatcttgagaaagtaccttattattcaactgtgcctcagtctacccattgaaacatagggctaataagagtacctcctcaggttagtgtgatgagtaaataagctaatatggaagacacttagtgtatataacaggtactcaaaaaacatttgttaaatagttgctggatgagttgagtgtgttgtttttttggggaaaagaaaaaaaaaagactgcctctcacataagacaaactgaaacagcagacaggatcctgggatacagtacagaaccatctcctgcccaagcagttgtcaactgctttcctcaagtattttctttttaaaaaaaaaatcagaccttttccaaccatgacgttagagaattcaggaaagcagaagaatgggctgaacatggcccatgtctggaagcaccaaaacatttatgttcaggaaaattggagagaaaaacaatttcataatgggtattaagttaattaaatttcatctaggcctgaaatacatgaaaacagaacaaaaaccctcccactttttaggttttttttttttttcccagctcttttacttggacatcttaaaattattcacaattaagtttttctcatataagtctttggagggtaacatcgttttcatttaaaaatgggaaatggaagcagaagaaaactagatgataaagttctcagttcttcactgtgattaacagctaagcagtggctaaaagcttgcatttttggtgttagattccaaatctaccactaaattttcttatcagtaaaatggggaaaagaacagtatttatttcactcagttgttgtggagataaaacgagaaaatatgtaaagggcttgacacttaggaagtattcaacaagcagtagccattattattaccacaactttaagatcactattgataagtttagaggaagaaactttttatgaagtgaattaccttttgggatctgggcactatggagaaaatatcaactaacaatctgcttggggactctatctctggaggagaaacagactacacttggggcagtaagtcagagttctaaatgttcttggaccatccttcatacaaatctcttaagtgatggtagggtgatctcaacctaaatcttttaattataaattccactctcatttcactatattctactaccttaccatagtgctcactttaactggaccacaagttcagtatagttttcattgtctgagactttaggactttattggttgtatcttcaaggataatcttctgaaatgtgaggccaaatgcttggagttcaagtttctttagtagtcccagcagacagagaaagattaaaaaagaatgtagcaacaagtgtgtgtcaatagaaaattattttaattgaaatgatctattttaattatcaacaagtgtgtgtcaatagaaaattatctattgacacacacttccttctttctactaaccatgacctctaaacttctctttccatgctttaataaataaaaggagatttcttattaaggacaatatattatcttggcaattataatccttttattgataatataaacccagacaaatagtctatctgtaataatatataataaacataatggccatgccctaaaatcaacagcttaagttataacaaacttaataaaataaatggtaaacagaaaaactgctccaccaacataaggctaaggcaaacacttaacaatgttatttactccagggggatttttatctccctgcctgcttcctttttctttgaacaaatgtttttgtatacctactatgtacttgatactgggctactacagtgaagaaggacacaatctctattttcaaaagtgtggtctaaaggccaggcttggtagctcatgcctgttgtcccagcactctgggagggtaaagtgggatcgcttgagtccaggagttcgagaccagcctgggcaacatagtgagaccctgagttaaaaaaaaaaaaaaaattagctgggtgtggtggtgcatacctgtagtcccagctactcgaggggctgaggtgggaggatcacttgaggctacagtgagctatgactgcaccattgcactccagcctgggcaacagagcaagacccggtctcaaaaagaaaaagtgtagtttaattatgggaggggaggggacagatgagtcaaactgataaatatgttatgtaataaacattatgatagagatatgcacaggataccaggcagacgcagggaaagggtattcactttttttgtagttacaatagttttcaggaaattgcttttccatgccttcttaaaaaaactgattttgaattccatctgtatcactttatcaacatcttttttttccctcaaagatgactaggaatcagtgactgtcttttactaggtaaaatttataccatcaaatggcaccaaaaatctatttaatcatgaataaatatgccagttttgtagacttggtcttccataagttaatttatgaccactgatggaataactcagattaattattgaagaagttacaaagttctctccaatctgattggctataacaactgaaataaacaatcagtctcccaaagggttttatttgttgacatggctcttaattacagtgatacattctttgcaattacttgcattatttcattacaaagtgaatgcatcgcctttaagaaaaactagtcttgccctaggcctggtgctatttacctacctaggactaattctcagtaaagacaaagaggcagagtttaggcttttaaaattccactgcttctttcacaagcagccttctggaagtcatcactgaagctgtgttcctccaggctttttttgtttattgtctctcaacttaagtaaagtactgaagttagacaaggttctacattttggtatccatctctgggatagggaaaatgattcagaaaatcagatagccggggtttgaaacagggctgaaaattttagaaactgtgattttgccatgtgagccgcagtatccttattgtgaaatggtgaataatgactttttccttgtagagctgttacagaatgcaattagataatgtttgtaaagcacttaaactgtcttttggcacagggaaagcattcaataacctctatttaataaattccagcaatacctttcctagtagcgtcaaatttgttaggtttacattaaaaaaacacagactatgcaaaattttatttgtatgtctaatttttgagaggaagtggtggttttcattagatcttgaaagatttctgtctaaacagtagttaagtgtagaaccaaggaaaaaaactggaagttaaaaactcatctatgaccacttgtctgtaaataaacattaagtacaaagatcatgttgattctcaaagaactccaagcagatttgccactgcagtttcccaccaggaggtcagggtattgaggaatgcatgctaatacccacctttttatctaggaaaagacaactaactatcgaagaggcagttaccacccattttttccctattcaagttttagaatcagtcaaatctagatttaaatacaaactaagtgactttaagtaatttaacttctttgactatcagtttcatcaagtataatatggggataagaatacctaccacatcatctgttgtgaagattcaataaaataatatatacataaaatacgtggcactgggggggtcgcggtggctcatgcctgtaatcccagcactttgggaggccgaggcgtgtggatcacttgaggtcaggagtttgagaccagcctgaccaacatggtgaaaccctgtatctacaaaaaatacaaaatcagctgggcatggtggtgcacgcctgtaatcccagctacttgggaggatgaggcaggagaatcacttgaactcgggaggcggaggttgcagtgagcggagatcacactccagcctgggcaagaaaagcgaaactccgtctcaaaaaaaaaaaaaaaagtgatacggagcctgacctatttagtttcaatttttgttgttgtggttgccattattctcatcaactcctccctgttacactctccatttgggaagataacctgcaacgttattagtagacaaaaagtgaggaataaagatttctgtaattcctttgatgctcctgggaaggaactgaacacagggatccctggacaagggaaatggaacttatagctaagatgctgtggataaagctggctttacaaataatcagaatagatgactccaatgtcatgttctttgaggggtcctggaaaggaccacccagccctctaaattgctttcactgccatcctgcctgaaattccatctttagaaacactgtaattcctctggatcactaagagctcctgagtgggtaccaggactcctgagaggtccaccatctctctttattggaaccccctccccagagtaccagttcctccacaggggaacgagactgagccacttacagctcctgccttgaagactgggaagggagggtgggggtgagggtgggagaactcagggttcctggcgaggaacaaaagccgggaaggagagttctccaaaacgcagaggaaagcggagggggaaaaatggggcagaaagtggagctagaaagagaggtaagaagaaagccagagagacttcttccttctgcaaatcggtctaagtttcgggaggtgggattgggggaggagggggttcaccctggggccaggccagggctgggtggaggaggcggccttcgagagagtgagtcgggaaagaaggggagtgggcaaagggtgagatgtggggtcccggtccccgcctcgctggctgccagttccctctgcgtttcctagtccgcgtgcgtgacacgagatagtgcagccctggcatggggcttggcatctggcggccgcgagataaccagggcccgtgcgatgggaaacgtgccgttggcagcccgccacccctccatcgtgacctcagtctgccaaacagggttcgtgatgctcagtttactagggaggagccgcggctttgagatctcgcccagcccgaagcagcggagactggccaggagcccggctgtcagacctcggagcgcacgctgcgggcgggggctcggtccacgggggagggtcaggggacgcgggactcacccttgaaggagtcggggagccgctgggcttcggagtcccgtgtgtgccgcttctcggccatgctgcccgagacgcagtcgcactcccccgtcctcgttgccaaacccggagccgccgggaatgccctgaggagccagaggcacaagacccagattgccgccccgcccccaatcgaggtcccgccctcgtgagagttggccaatcaacgcccaggatcgaggaggacccacctcccaatccccgccctcctgtccctccacggcgcgactgcttcgcagtcacttcccgctagttctgtgggctgaggggcgtggcctgaggggcgtggcctgaggggcgagagcccccaaggctgtgggtatgaggccggggccctgcaccggaagggagggcggaagccacgggacgtggagcagatggtgaggatagtggggaggtagcagcagaggatgacccgaggcaaaagtgcaagtgaagaaaagtcgccttgccgggcagaggtacgggaccaaggcgcctcctctgggctgaggagttagagggaagaaaatggcgccctgtcatgagggcgcgaggtccgagttgaggggagaagactgagggacacagaagtggccgaagtgagggcgctgaggtcagcctgagctgagagggccggcagatcacgccgcagccgaagtgaacgaactcgagtgaggtgtgttaagaaaatcaaaatgtataaatttggaaaaggagaggaggccgggcgcggtggctcacgcctgtaatcccagcacgttggaaggccgaggcgggtagatcatctgaggttagaagttcgagaccagcttggccaacatggtgaaaccccgtctctgctaaaaatacaaaaattagccgggcgtgtggcgcgcgcctgtaatcccagctacttgggaggctgaggcaggagaatcgcttgaacttgggaggcagaggttgcagtgagccgagatggcctgggtgacagagcgagactccgtctcaaaaaaacaaaacaaaaaacaaaaaaacaggagaggagactttatttcttgtaaggggttacagcctgcaaggtggccattccgcaggctggagaatggccaggaccagagacaggcatttcgttggaggaggggttggagtagcggctttatgctgaacagcttgggtagacatgcatattcagcaggtgacaggaggagctatgaatattcatgagggtggtcctgacgcatgcccattgagcaaacatgcatgtaacatacaacccatgttcattttggagtgaagagttaccaattaaatgttaaatgcctggcctgcatggtgacgtccccatctctacaaaaagtaaaaaaaaaatagccaggtggggtggtgtgtgcttgcggtcccaactagtcaggaggctggggcaggaggatcacttgagcccaagagttggaggctgcagtgatgtatgatcagatcactgcactccagcctgatggactctaaaaaataataacaatacatgtattacagttagaccccatgcgtcaaaaggtcttttcaggacaggaaggtgtgcaagtatgcagtctgtgtaaactagccagagccagtccatggtcggtagttttcctatgaggagaaagttactgaaatcagcctcttgtccaattaaagctgtaatgatggctggtggaataggggttccattaggccacatctggtggagctgcaaattgttttaatattgcttatctcgaggccagtgcttgttaagctgctagagaaagagaacaaccttgtggcagttagaacacagtttattctctaagtgaagggatgtgtgccttaacctttgcctggcatgaccttaggtataatttgtttataatttggtatcttattgtcacaaacagtctgttctgtcagtcttatgatctgtgttttaacgttaatgctggtcagctgttgtgtctaaactccaatacgatgaagttataatgaggcgagtctgaccttctgtcctgtcattggctgggaactcagttttaaagttttctggagtccccttggccacaagggagtccattcagtcggtggggtcatttattcaaacaaaatcttcttggagcatcttccatgtggcagggagtgtgctaagggcctcgtggagtttaccttatactctagttgggagatgggccacaaacaagtaattgaatcattacacatggtgaaggaagctgtgaaaggagtggaatattcggagaacagcaaaggttaggacaggggaacacctctgtaaggaaggggctttgagatgtcgcctgagaaatgagaaggagccagcctggggaaggggaataagcggtgcaggaggtgggaaagggtatcccaggtagagggaaaagcatgtgcaagggcattcccaacctcaggccttctcttggggtgtggctgaagacctcatatttggaaagtaggctgtgtttgcattagacttgttctattgcacaatgttcaaagtatgttaatgtacacaaggtgcacttataaaaacattcgattttgaaataagtacagattcacaggaatttgcaacaacagtacagagaggtcacatgtcccctttacccagtttcccccaatagttacgtcttacttaactagagtatcaaaaccaggaaattgacagtggcacaaaatgtatttatagttctgtgccattttaacatgtgtagattgatataaccacagtaattgatacagaactattccattaccacaaagatctccctcaggaggagcacttctttcttaatgtgctcaatatttggctgtgtactacccaacaccttgtggtgcttaggtcatatgaaatggtagactttctctctgattttacagctctggagctttgtgactatcaggacggaaacgggagcagacacaacaggtgttaagagaggcattaagatgatctttgcttgcaggaacaggctccagtgtgtgatcaaaacctgactcagagcttgcagttgacttttagtcaaatactggccaagaactgtttgtattcctgggatggagtgcagcttgtgcagtcactttgttagccttctggagaagataaggaggggagtacagtaatttaatgatcccttctctctaaatcatccttgagaaagtccatagcttcatttttccattctgtaacgaataagccctggagacataaacttcccgtttatcctgtcattcccaggaaagaggagcaaatacacaagaaactaattaaacccttcggtagaggaggccttgattacaaattgcatattgtgaaaaaggatttaggtttcatttttgttggaaaggaaaatggtatttcaaaatgaatttaatatgtgtacccctatcagttacctaagcccaagtctcaagacaatcttaacagtgtagtgtcccttctggagaattagaagtgtctccctttggggtaaagactttggtaaacacttcttggctctggtttcagattgcatcagttctaaaactaattcctggccctaaactaagaacaagctttgacttgatttttaaactgcttttagaatagagtttccaattttttatttaaatatgcttactctcacttgcccatgaaattggtgtattctggctttctcgtgcatattctgttataaatgtattgattaaatgtactttaaaaatcaatttctcactcttaagattagaaaaaaacaaatattagtacatccctttctccttttggaggatttttaatcttaaattttctcccagtaatgattagaagttagaatgattttttttaaagaaccttatggccaggcgcagtggctcatgcctgtatcccagaactttgggaggctgaggtaggcagatcacttgaggtcaggagtttgagaccagcctgggcaacatggtaaaaccccgcctctactgaaaatacaaaaaattagccgggcatggtggcgcatgcttgtaatcccagctacttgggaggctgaggcaggagaattgcttgaacccgggaggcggaggttgcagtgagcggagatcatgccactgcactccagcttaggcaacagagtgagattccatctcaaaaaataaaataaaataaataaataaataacattatgctttttaaatggagacatataaaattgtgagtactttgaagagagaatttcttatcacctctaacaaaactgctattacaattttggtgaatttttcctctagttgttatttgaaggatacttatatatagtttgaaaatcagagtagatgttccatatttcctttattttttatttttattttttattttttagatggaatgttgctctgtcacccaggctggagtgcaatggcatgatctcgactcactgcaacctctgcctcctgggttcaagcaattcttcggcctcagcctcccgagtagctgggactacaggcacctgccaccacgcctggctaattttttgtatttttagtagagacggggtttcactgtgttagccaggatggtctcgatctcctaacctcgtgatccacctgccttggcctcccaaagtgctgggattactggcgtgagccaccacgcctggccgttccgtatttcctttatgttttattttgctgttatttgcctagcatattcaaggtaccaaattaagtattgattgatggtaatagtgataacattaagacttggagatcaggttaaagacagatatgcaccatgaatccgtaattgaataagacagaaggaaatttaattagcctttttcctgtgtccatagcagtgctttaataagaacaatagaaaagtcttttttttttcctttaaattgctaatccaggatgttttcgatgcttttatggaagtcagctaactaaataccttgagagaacagcaataccatcaaattacatctgtctgtgacattttctctaggatgggactaacaaatttgatctgtttttttttaatatgtattaattcacacttattgcattacaacaaggtttttgtcttcttagctcttctctttttcaggaaattactccaggatttgaatcatcacaagagattcaccagaggattttatacacttgggctgtggcagcagactaattacatcacagcactaggtaagataccgggagtccggatcctcaggacttatgaaaataaaaagcattactgtaatattagtgctatttattggagttatctatgaaaagaatcttattaatctgcttttttattagctcacttagcaaatatttattgcataccaactatgtgccaggcattgttccaggtgtttgggccacatcagggaccaaaaaagaccaaaattcctgtcctcgtggatctcacattctagtattcctttccatatgcattagcttgctagggtttccataacaaaatatgacagactgggtagcttaaacaacaggaattaaattttttttttttttttttttacacttctagaggctagaagtgcaagaacaagatgttagcagggttggtttctcctaaggaccatgaaggaaggatctgttccaggcctctgtctttgacttgtagataaatgtcttcttcctgtgtcttcacattgttttttgtttgtgtgtccgtgtccaaatttcttcttcttagaaggataccagtcatattcaattagagtccatcctaatgacttcattttaacttaattacctctttaaagatcctttatcccaagatagtcacatgctgagatatatggtgttaggacttcaacatgtgaattttgggggaacacagcccataatatcacatatgattactgtgtatccacatctttgtgttgtctgtgttctcctatccacatccctgagatatccaaagccatttatgtttacttgcaaaatgtgtccagtgacctgtaattatgagtgattacttttctaggtatgacttattattttgaaagttttactttttaattgacatataatagaggtataaattttcagggcacatgtgattattaaatacatttgtataatttgtaaaggtcaaatcagtgtaattgggatatctatcaccttgtttgttttttatttatgttagaaacatttgaattattctcttttcgctattttgaaatatacaagacataatttaattttaagctatactaaaaagttcttggttaggaaggattattctacttggaatgatgctccatctagtgttcaccatattctactacttttgttaaagttttaaaaatgaataaaggggaaactgtgttgaagaaggggtcctctatttaacagttaggttcttactcacagagcactatggattcatagtaaaaaaaaaaatattgtttcaaataccatatgtgggaggaaagagcggtctatataagacattacttttaataattcaagaaatatcgttaccatcatttactgtcaccaccagttacgatgtacttttatcccatgaggagactgagactgagtttagtcatttacccaaaatttcacagatcttggtcaggtacaagtcagtgatggagatattgtttgccctacatacactgtgtaattcctgaatttgaactcctaattattcagaataaataaaaagagacaaaaagacacaaacttgtcctgatgcactttttagatatgaacacatgtaagcatatacctaattgggtactgaagtttcccttcaattttagtacattttaatccttgtcttatattgaaatgttatctttttgttcagtattttatcattgttgatgtgctgtgtcagaatgtgtctgtccatcttagatagtaaatttataaatgacaggacttaatccacaaccaaatcagcatattatagtttatttcattgtatatcttgaatgaaattgaaaaatttaaataactatttaaaagtttggactttcctctttgtagttttaaaacataatttttgtttttctcttgtacaagttgaatggggcagcttgactgcttggagacatcaggaaagacttccagggaaacaggagtttagtaggataaacatggcttacaataggatgcttcaggaatacagaaaggtccttgtaaattcataggcgtgtgtcagagcttgacacttttgggtaaatgtaagtagtaacagtgcaggcagtggtgttgaaaaatgacagtggattaaaaggcatagcctaaacttaaaagataactatgaagctgctcaaagagcttaacaatgggagtggaatgaacatattggacttatcaaaatattatataatggacaatctaaataggcttatatatattaaataattgaattaataatgataatttctagaacagaaagcaccaagtccagatgggctcattggcaaatcctaccaaatatttaagaaaaatattgtaccaatgctctataatctttcagaagacagaagcagaggaaacatttcctaactcattttatgaggccataattactctaatatctaataccaaaatcagacagagacattagaaaaaaagaaaactacagacaaatatggcttatgaacatagatgcaaaagtcctcaacaaaatattagcaaatccaatccaatgatgtataaagataattatgcattatgaccaagtgcagtttattctaataatgcaaatctggttcaccatttgaaaatcaattaatgtaatctgtcatatcaacaggctaaagaagaaaaatcacatgatcatatcaatagatgcagaaaaagcatctgacaaaaaccagctctcattcatgatcagaactctcagcaaactagtaatagaggggaacttactcaacttgataaagaacatatgcaaaaatctttcagctaacatcgtacttaatggtaagaaattgaagctttcccactaagatcaggagcaaggcaaggacgtctcctttgaccaacccttttcaacatcatatttattggaagtcctagctaatgcaataagacaagaaaaagaagtaaaaagtatacagattgggaagaagaaaatagaactgcctttgtttgcagatgacatgattatctatgtagaaaatctgaaagaattgaccaaaaaaaccctcctggagctaataagcaatgataacaaggtggcaaaaataggttgatatacaaaagttaattgctttcctatatgccagcaacaaacaaatgagatttgaaattaaaaccaaaatcccatttacaataatacccccaacttaaatacttaggcataaaactaacaaaaatatgtaagacctttataagggaagttataaaactctgatgaacatataaaaagctaaataaaggagagagattccatgtttatggataggaagactcaatattaccaagacatcacttcttcccaacttgatgtatagatccaaggcagaccaaaccaaaatcccagaaaataatttcctggatattaacagaatctttttttttttttttttttttcctgaaacggagtctcactgtgttgcccaggctggagtgcagtggggcgatctcggctcactgcaagctccgcctcccaggttcacaccattctcctgcctcagcttcccgagtagctgggactacaggcgcccgccaccacgcccggctaattttttgtatttatagtagagatggggtttcaccctgttcaccgggatggtctcaatctcctgacctcgtgatccccccgcctcggcctcccaaagtgctgggattgcaggcgtgagccactgtgcccggcctattaacagattcttaagtttataaggacaggcaaaagacctagtatagcaaacataatattgaagaagcacaaagttggaggactgtcactacctgacttcaagacttactataaagctacagtaataaggacagtatggtatttgcaaaataatagaaaaatagatcaatggaacagaatagagagcacaggtatagacccatacaaatactatcaactgattttttttataaaggagcaaagggaatacaatggagaaaagataagttttcaacaaatggtgctgaacaaggggatgttcacatgcaaaaagatgaatctagacacagatcttaaacttcacaaaaatcagctcaaaatggattatagactgaaatgtaaaatgctaaactatgaaactcctagaagataacagaagaaaatctagatgaccttgggtttgaggtgaatattttagatccaacaccaaaggcatgatccatgaaagaaataattgataagttgtacttcattaaattaaaaacgtttaatctgtgaaagcactgtcaagagaatgaaatgacaagccacagactgggagaaaacatttgcaaaatacatttgataaaggactggggtccaaagtactctaaaaactcaccaaagaagacatacagatagcaaataagcatatgaaattgtcgacattgtatgccattagcaaattgcaaattaaaacgagataccactacatacatattagaatggctcaaatgcaaaacattaacaacatcaaatgccaaatgctggtgcagcaagaactcttcattcattgctggtgggaatgcataatggtagagccgttacacagtgccaatcataatccgaaagacaaaatcccaaatgccataatctcaaatgcctatgaagtgttcggttgtgtttttatgtttctcaaacaaacctcctttacaaatgtaagtaaatgtctttaaaaaattgttttttaattatctttccagaattatattgtgattttggtctatcaggatcaggatttttgggattttagactttagggattttgatcttttgggatttcaacatttgatattacagcatttgcaattgtatctttcaggagtatggcccaaaccccagccatgtagaaaacaatttgataatttcttaaaaaactaaacacccagccactgttgaaaatagtttgtcaatttcttaaaaaaactaaacacacttttgccatacaatccagtaatcatgagccttggt

SEQ ID NO: 91 - DNA, 44255 bp, Homo sapiens
ccccagaactgtagctaaggcccatgagacctggagccaaaggcttagggaaggaccacagaacagcaggggtcagagtgggccttgttggagccaatgtgcagcctgacttttctcctaggcaaatgaggtgctctaaagggccccaactgatttctcactttattagtcagcaccgagcacagtgtcaaatacacagaaatggctcaagaattgtctgtgagccaggcacggtggcttatgcctgtaatcatagcactttgggaggccgaggtgggtggatcacaaggtcaggaattcaagactagcctggccaacatggtgaaatcccgtttctactaaaaatacaaaaaagttagccaggcgtggtggcggacgcctgtaatcccagctacttgggaggctgaggcaggagaattgcttgaacctgggaagcagaggttgcagtgagccgagatcgtgccactgcactccagcctgggcgacagagcaagactccatcttgaaaaaatttttttaaaaaattgtctgtgaagtcttatgatgtggcagatgctgttccgggagttttatattcggaacacgtttattcctcaaagacagggctgtcatctgcacttcaaagaagaagaaactgagcctccaagagcttaagggacttgcccaaggcccttgtgactcaaaagcccaggctcttctctatacactacagtcgttaatgtggccgctatgtgttgcacatactaggaggtcagtgaacacatactgaaggaaaggacacacatgcaccaaatttaacccttctgctagaaaagcatttaagaaaagagaagctttgggagtgagaaaagaaggtataatgatatgatacatagggctcagcaaaataacttcatctcccagattccaataaaacacagacacctttcccctttctggtttcattgaaacagcaatgctgacatggactatttctaatcctgctggaggctggcctcctatcagatgtggctaaatgcaaggtttggcatcttctgcagacaactgtaggattactggggccactgttcacaaagtcggcccagcaaaggacactaacagacaagccacagaaaggaatacaaatgactaaaaaatatgaaatactgcatatgcaacttgagtaattaaagcattgcaagttgagataaggagttgccatttttttaacctattgatttggcaaaaatttttacaaactggtaatacttgttatggtctctcactgttgatagaaatataaagtgatacaacctttccagaaagccttaaaagtgtttatactctttgacccattatttccactttttttttttttttttgagacggagtctcactctttttgcccaggctggagggcaatggcatgatcttggctcaccgcactctctacctcccgggttcaagcgattctcctgcctcagcctctcaattagctgagattacaggcatgtgccaccatgcccagcaaatttggtatttttagtagagatggggtttctccatgttggtcaggctggtctcgaattcccgacctcaggtgatctgcctgcctcgggctcccaaagtgctgggattacaggcgtgagccactgcacccggctcattatttctacttttaataatctagccaaaggccaggcacaggagatcatgcctgtgatcccaacactttgggaggcttaggtgggcagatcacttgagcccaggagttcaagaccagcctgggcaacatggtgaaaccccgtctctactaaaaaaaaaaaaaaaattactaaaaattagcatggtggtatgcagctgtagtcccagctacctgggaggctgaggtgggagatcacctgagcttgggaagtcgaggctgcagtgagccatgatcatgccactgtactccagcctgggcaacagagtaagaccctgtcccaaaaagagaaaaaaaaaagaatctatccaaaggaaataaataatcagatgtaaatatgtatgtacaaaaatgttcaccagagtgttatataattacaaaaattagaaaaatctaaacagttaacaaaggattagttgagtactttgtgctgtatgatgtttctatgtagaaacactatacatctataaaaaatgatactcacctgcctagcactgcctgcccaacactgcccacccagtgcctgtccccagactatggcccagccccctttgcccttgtccatcaaaggtgccgccagcatgtctgacaaactgccctacaaagttgctgacatcggcctggccacctggggacacaaggccctagacattgtggagaatggatgccgggtttgatgggcatgcaggagctttactcggcctccaggccactgaagggtgcctgcattgctgactgcctgcaaataactgtggagacggccatcctcattgagacccttttctccctgggtgttcaggagcagtggtctagctgcagcatcttctccacccaggaacatgcagtggctgtctttgccgaggctggcatgccagtgttcacctggaagggcaaaatgaaagaggggtacccgtggtgcattgaacagacactgtacttcaaggacgggcccctcaacatgattctggatgatgggggtgaccttaccaacctcatccacaccaagtacgtacccacagctcatgtcgggcatctgaggcatctctgaggagaccaaaaccggggtccacaacctacacaagatgatggccagtgcaatcctgaaggtgcctaccatcaacgtcaatgactccgtcaccaagagcaaaatttgacaacctctatggctgccaggagtcccttatagatggcaccaagtggaccaagacgtgatgattgccagcaaggtagcagtggtagcaggctatggtggtgtgggcaagggctgtgcccaggccttgcagggttttggggcctgcataatcatcaccgagactgaccccatcagtgcactgcaggctgccatggaaggctatgaggtgaccaccatggacgaggcctgtcaggagggcaacatctttgtcaccaccacaacctgtgtcaatatcatccttggccggcactttgagcagatgaaggatgatgccatcttatgtaatactgaacaatttgacgtggagatcgatgtcaggtgcctcaacaacaatgctgtggagaaggcaaacatcaagcccaggcggactggtactggctgaagaatgggtgccacatcatcgtgctggctgagggttggctggtcaacctgggctgtgctatgggccgccccagctttgtggggagtaactccttcaaccaggtgatggtgcagattgcgctgtggacccacccagacaagtaccccattggggttcacttcctgcccaagaagctggatgaggcagtggctgaggcgcccccctgggcaagatgaacgtgaaattgaccaagctaactgagaagcaagcccagtagctgagcacgtcccgtgatggccccttcaagccggatcactactgctgctgagagtcaggcctgcccttcactttccagctgctgtccttgctcaggccccgcctcttctccctaagagcaaatggcaccaactttgtgattggttggttagtgtcccccatcgatggggctggtcactcagtttttggcctctgctgcatccctaacactatatcaagtgtggcggggaaattgagaggcccctcctcaagccctggtcatgatggaggtacaagggaggcatccacaaggaaccatgagttgagtggtcttggaactgctcactaagtcagtccttccttttttttttttttttttttggtatttttggtagagacggggtttcaccatgtgggccaggatggtctcgatctcttgccctcatgcctcggcctcccaaagtgctgggattacaggcatgagccactggcgcccagtcagtccttccttagtttggaagttggtagtggagtcacaaagcccatgtaccttaccattcaggtaaggttcctggtctgtggacttataccgtgttcctggtctgtggacttatacccgtggtttacaggttcagtggttccccagcccatgacagatgagaaggagctatattgaaaggcaaagaggaactgttgtttgaattttcctgagagcctggcttagggctgggccttctcttaaacctcataacaatgaggttggtacttttagtccctgttttacaggggtcagaatagactgtaaagggataactgagaaaggacagagaagtgacagccagaggggctataaaaacataaaagcaagcatagatctgctactactttgtaacaagatggttcctatcacaaccctggttcaaaaagagaataatatggttttaatgttaaaagaaagcaggaaggtgggtaaataaaaatcttggtgcctgaaaaaaaaaaaaaaaaaaaaagatgatactcaagcacagtggctcatgcctataatcctgacactttgggaggcccaggcgggtggattgcttgagctcaggagttcgagaccagcctggcaaaatggtgaaaccccatctctaccaaaaatacagaaaaatttgcctggcatcgtcgttgcacctgtagtttgagctactctagaggctgaggtggaagaatcacttaaacccgggaggtggaggttgcagtgagtggagatggtgccactgcactccagcctgggtgacagagtgagaccctgtctcaaaaaaaaaaaaaaaaaaaaaaaaaaaagatacttatgaaggaaattcttataaaattgtggaaaaaatcattaatataactatttatgccatgattcccaaattgtgtaaatgataatatgtgcagagaataaaataccaaaaggaaatacaccaaaatgttaacattctttttttctgagtgactgcattatggatatttaacttttttctccttcatagttttctacattttccagtttttttaatagtgagcacttattactctcaaaatcaataacaatcaacaacagaattcatttgaatctgaagatatgtctctgccaaccacatccctgacctgccttcatggtatctcaagatgatgagaggaaggaaggctcaagttgtaaacctacattaaatgcaaggcaccatccccaaacaatgaagctaaatgttgaaatcctgcttcaaaggccctctgatgctaaaataagcccagaaaagcatttgctgcagttcttggagatctactgaaggacgtcattcacagtgggcaccaagtcaaaccctcactcgtcatcagtgttggctgcaatacaaagaatttgaaccatttgggggaggaatagggttagaccttcacaaataactctatcccttaggttgctatcattgtaataaaggggattactgacaggtgcacagcacagagctttcccaggcatcatctcatgtgaacttggcaacaactctggaggaaagacgttgatagtaacaacaacaataacaacaatgatggagacttaacatttactgaatacttattatgtgtcaggaatcaattctaaacacttcacatacattgtgcctcttaattaaaaagcaaacacaaaacaaaacaaaaacagggacttgctctgtcacccaagcttaattgcagtgacataatcatagctcactgcagcctcaaactcctaggcttaagtgatcctcctgcctcaaactcccgagtagctgggactacaggtgcacattaccttttaaaatttttttgtagagttggggtcttgctatgttgcccaggctggtcttcaactcctggtctcaagcaatcttcccctcagcctcccaaagtgttgggatttcaggcttgaaccactgtgcattccccttttaatctttttagccttatctgtgaagtagaaagagtgattacccccactttgcaagccagtatgttgtcactcaaagtagtcaaatgacttgtccgagatcgccacgctaacaaacgaaagcatagaacttgtagtcatttgtttagacctcaggtccagatttccacaactgcctactatagttcctcaactttgagtattttttattgctgtcgttattagaggagacagtagtttagcagtaaagaatgccgggttcaaatctggtctttctagctgtataatcttggacaagtcactttagctctgtgtctcaatttcctcctctgtaaaatggggatcataaaatttatctcataggcctcaaagtcaaatgaatataaagcattgagccaaagtctgccccataatgaacactcaaaagaccttggtacatgtctgattttcctataccttgccttctcacatagtcagtcaaggtcaggagggtacaatgtccttgtgttcaatgcccagaacttctagattttcagaagagtcatactctctgatttccatggcctcagcccttttgaagagcctcctttgctggagtgtgtgcctgtcagagggtagcttctaggactgagagagtacttggcaggaatgagtacttgactccttctgagaaatccttaggcctttaggactatgatgccctttgttgaactatttgaggtaggcatgttgatttcttgctggcttctgggggctcgataataaggaaatccacttctagaagagcaactgtttccctgaaaagaccacaaaaatggcaactatcacagctggaaggggacttggcatcagtcccttcaaacatgtccttgtacagataattaaccaagaaccacagaagtaaagcatcttgataagatcccacactgtcaagagccagggtcatattcaaaccctctgactcccaggccaccatcagacccaaatcagtcagtacaaaggaggcagctaagggccagtgagaggcctagaggctactggctggacaccgatggaccttcccaccttctgactctggttcaaggctctctttatgtccccaggctccctctccaggaatttccctcctagaatcacagaaatggcaccctgctgccagcttcttatcaatggccatggcaagattttaaataatgacaatactgaggcgggcggatcatctgaggtcaggagttcaagaccagcctggccaacatggtgaaaccccatctctacaaaaattagccaggcatgatggcaggtgcctgtaatcccagctactcaggaggctgaggcagaagaatcatttgaacccaggaggcggaggttgcagtgagccgagatcatgccattgcactccagcctggatgacagagcgagactccgtctctaataataataataataataataataataataataataataaaatgataataatcaggatctgctctcaggcagcagttgggaccttaggaattacaaaatcttccaaattaggtcacatttgtgtaaaggaattagaaacatctttcccatttcatcaggcccagattagaacagcctctgcagagggtcctagtagatcagtcctcctgtcaggcccatgggtgtgatttcctttctcaaacagccactgaacttttcttatgattatggagtgtttattgggtgtgtgcaatgtgtcaggtgcagtctggaatttggaactgtcacatactggcagcatgacctctttaagaggcaggaacttgttatctctgtcatccggtcccatgttggggaactatctatgaatcagccaagatgggttcccagccctccatccatctcccttcaaggcaaaatggtctaatgggaaaagtccatgatctagcatacctggctgctctacttccagcctatgttacttagagcaagaatcacctattttaaccttcagttttgtcagctgtaaaataagcatacaatacctggtctacctattgtgttgctaggaggaatcattcattcattcattcagcagaaatgtgttaaacactgatatagagataccctagtgtacaagacaacaaaaaaggtgcatacaatatagtaagataatcaattaacaaataaatgggtaaataatcaagatatttacagattaagcaagtgctacgagggagataaaaatggtgctgtgacacagaataatatccccttagagtgatgaaggaaagccttgctgagatgtgacattcaacctgaaagcaaaaggagtcaactctaccaacactggaaggaacagcaagtgcaagactttgaagttggaaagaaacagaaaggaaaccagaatgggtgaagcatattaagtgaaggagagagtggtacaagctagagggcaggactctgtagccagggaagaagactgggcttcattctaggagcaaagagaagtcagggagcgttttaagcagggagatgagggcagattatagagcagcagggacagaagcacagatagcagccagaaggctgagttgtccaggcgtgagaagatggtggcctggactggcttagaggcagattcagaatctgttttagaagtggaattgtcaagacttgctgttggattggtgtggggtgaaggaaagacagaaataaaaagttactcctagattttggaatccacaggatcactcactcactcatgcattcaacaaacatcaattaagcacatatacctgcctgtctctaggcatggtgttggggataaagatggagatgaagatcacagctttgtcagggaaatggaccagaaaataggcaaatataatgcatttaagtaagtgcagtaaatattaaagaacatcgaactctgctgaggggaaagaatcaaagaaaagtcttcctaggggaggggagtttgagctaagccttgaaggagcaacaggaatagcagaagggctctggggttatagaacagagctctgaaataataacaatcgtagtagtagtagtagtagtaatagcagctgatatttgttaaggcctcacaatgtgctaggtactgttgtaagcataaatgaatcatttaattctcacataagaatcctataaagtagatcctattaccatcatccccactttacagacgaagaagcagaggcacagttaacctcagttacataacttgccccagatcacactcataatgacagagccaggctttaatcgcatgcattttggcgctggaaactatgctccaaacaccgcaagaaactgcctcactgtgggacgtcaccgcacatttaggggcggacaacaggtgcaggaggtataaggtgtaggaaggtaggaactgatgggaggtcacgtaaatgacatgaaagtattttgcaaactataaagtgctgtccccaagcagattatcatcactactattataataaataactgcctttcctccctgtgaaaaatgaaggcttctcagcagtatctctgggttattggccttggaaaaaagtggctgcttggagggcctgcccagacagagggaatctcgggaaaggatgggctgacgtgaatctgaccctgagttgggaagcagcagatgtgggctctggtcccagctctgcacctaacttattatgtggtcttgggtgggttacctccccaccctgtctttagtttccccattgctaagatagaaggaggaaagagtggggatttttttttttccagacggagtctcactctgtcacccaggctggagtgcggtggtgcgatcacggcccactgcaacctctgcctcccgggttcaagcaaatctcctgcctcagcctcctgagtagctgggactacaggcacatgctaccatgaccagctaatttttgtattgtttttagtagagatggggttttgccatgttggccaggctggtcttgaactcctgacctcatgtgatctgactgccttggcctctcaaagtgctgtgattacaggtggctcacacctgtaagataatcaattaacaaataaaagagtggggattctaaggcctttttcagccttcacattttgaacaatcgctgctactgttggtgttccacttctccgagctggacagtgaccgaaaaagaatgtcaccttggggccctttaccaaaacaaaggcttgctggcaacctcggatggcagtggcaccttccagaaagcaggacccatgctggatgggaagcccatggcttatgtcccctgagtccacagatctccagttcagacgcttctcatcactcctgtccctgccaggacactcactggtttcaagctccttgaaccaggcccattcctgtcccttttaatgttccagtgggagtctgagtaatgacagcattctggataccatcctttccaggatgtggccagaagacgcagatggagtttacatcctaaggggtcccgttttgatttttctgtgagccaaaaaccccagggctttctcacatgcgctgctccaggctccatcttttgccattgagggttttgtattcactgtcctggaattaaaagtgttctcaagggatgcagcattgagtctttctcctcatgtctcaggatcttcatcatgagaatacaatcataagcctgcaagagatccccttacatcaaagtcattcaatccaaacccttctcgctgacacagaactccgtaaactgtaaagcactgttgtacattattaattcacatattattccttctgtaccttataaaagtcctagtttgggcagggctaggattaccagataaaatgcaagatgtccagttaaatttaaaattcaaatttaactaggcatcttgtgatttgatccattaaatctagcagcccttgatgggatcaacagtcccattttgcagaactgaagctcaaagggatgaaaggattttacccaaactgcttgagagcagggactatgtctgactttttaaaaatatttttttcaaacatgagaagtatattcccttaaagccagtgtatcagtccatttagcagtgatctaaaagatttatgctttgtgaaaagcctattcatctatgaatagagaatctatgccctgtgtctgtgtaggtgtatatgttgcacagaacattaaaaagttaataaattcatttttaatccccagttcccaagttggggttagctcagagaagatgcttgagaaatgtttactcaactattgggctttctgaatctttcattcctacaagaaccctacagaatgaaaaagaaattgctggctcaggacaaagaatggccccagaatgcagtgtcaggcttccctgatcttcctacatggctgtgccaaagatgagttgagtttcaggaaagtgcagtgaaactatcagcagtgaaactatcacatcatgaaatagtcatgggcctcacgaaaaggcttcttgtcattacacttccttcctgctccaggtttaagaccacagggaggcttccctaaggctgccaaatacagcgaggtcttggcataaatgttgcccaaggagtccttacaccatcaaaggcagaggcacaaagtccctttcctgccctttggatgagtagacctgttgggggcgctggtgggacagcccccaggtggcttctagacttagctcatctccctcctgatggacagctcaggatctgtccactgacagatcacatacttttttcagctgcccagccagagctgtgaataaacacagactctccgagaagacttgagctgccgatgacagaggtcaggggtcttggttccattccaggctgtcagctaagaaagaggatctgctgaagaattggagcctgggcatgagctcttgccatggatggaacttttttcatgtgtgaggttcaccagttaatcctagaacgttagagttagaagagatggccttaaaaagcacctaggtcaggccacgcatggtggctcacgcctgtaatcccagcacattgggaggccaaggcgggcagatcacctgaggtcaggagttcgagaccagcctgaccaacatggagaaaccccatctctactaaaaatacaaaattagctgggcgtggtggcacatgcctgtaatcccagctacttggaaggctgaggcagcagaatcgcttgaacccaggaggcagaggttgcagtgagccaagatcgtgccattgcactccagcctgggcaacaagagcgaaactccatctaaaaaaaaaaaaaaaaaaagcatctaggtctaatccaaacattcttccaggaagacacaccaaggctcagagcaggaaaggactcattcaagctcacatgataacttggcagcagaaccaggcctggaatgcatatttcttcttggtgctgcattcctgattcagaagagcagctctccctgctaagcaaacagcaggtgggcggatgtggtcactaatcagtgcactggcactgtgggtcattgagctttaaccccagagcaccattaacagcttaacccagtctgtcaccctctcctccctggaggccctgcagtcctcaggattagaaataaactgctctcagccaagcccctgaaataggagatgaaatggcccacagagaccatccaatttagttcccccagtgatgccgaatccccaccctctgtgctgggaagcagttccagtgaccaatgagctcagtgagcttgcaggtgtgtgggcaggctgcacagaagcagagggtggcgagtggaccacagggggatggatgggcatggaactggtgcagttaagcatcggcgttcccattctgtctcctgtcagctctgttctcaagtccttttgctattacactaaagcccatctctgtgaacttctgtctactgggtccagctcagatccctggagcccaggccacaccccttgtgaagctgctaaattaggcgggaaccctggtctgcatgcaggactggctgcctggctctgttccctgccaagccaatatctgtataccacttaggagaaaaactctaaagccaaatgaggaaaagcaaggacggctctgcctgtgatccttggatggatcccctgtatgtgccagcactattctcagctcttagcagagaacagaaaggctctgttgctgttctcatggagtttatgttctggttagggagccagagagtatatgggtacctaaataaatcagataatttcagaaaatgacagtgctaagaagaaaacacagactaataatgggatagaaaatgactccggggtggcatgtcactttcacaagcatggtcaaggaagccatctgggagaaggtacacattgagctgaggcctgaatgagaacgaggaggcaggctggggaagaccagggagacagaatggtaaatgcaaagtctcatagacagacacaagcttcgtatgtgtttgagagggagaaaaaagctggaatgggtagaatatagcaaatgagagagagaaaatctgaaaggaagttttggtctgagccacagtctagtgcgctgagctgggctaaaggttaaatcatggtgatgattccgcttccagagaaacagagccacagcaaagcagaaatcacagcatcatcatggtgctaactgtgaaggccagatgcccactggggcaactccactgtaactgcagctcagtcagttctccaatccaacaggaaacacccatcccaggtttgtttctaagccagatgacctcaggggggcttgtctgctgctcccccaaagcacagtgttcttctcaaggagccccctggggcagaggcaactagagaaggaagcctacatcttaagagtttttgtgaactatagaaggctagaccatgagcttcacctccttcacgggcctccttttcttgctttcaggaactgatcttctcttctcttctctctcttctttccttttttaataaaaactctcatggcgtcccaggctagagtacgcagtggtgtgatctcggatcactgcagccttcgcctcctgggttcaagtgatcctcctgcctcagcctcttgagtagctgggactacagtcttgtgccaccacacctggctaatttttgtatttttagtagagatggggtttcaccatgttggccaggctggtcttgaactcctgacctcaagtgatctgcctaccttggccacccaaagtgctgggattacaggcgtgagccaccgcacccggccttgctttcaggatcttcatggggtctcttcacctccttccccaaccaggcctgttctcagagtcagctttggtaaaatagttcactctgggatataaatggtactgtaccctctcccaggagtcctgtattttatcaagagtcaaagtcctggctgggtgcagtggctcccgcctgtaatcccaacactttgggaggtcgaggccagtagatcacttgaggtcaggaggtcaagaccaacctagccaatacggtaaaaccctttctctactaaaaatacaaagattagctgggcatggtggtgcgcacctgtagtcccagctactcaggaggttgaggcactagaattgcttgaacccaggaggcggaggttgcagtgagccaagatggcgccactgcactccagcctgggtgacagagtgaaactgtataaaaaaaaaaaaggaatcaaattcctaagccaaataaatgcatctatagttgtgtaaattaagaaatctgccatccaggtggggagggggtacctgttgcatcagcaggttgatggcggggccctgcctggtcggtgtggttctccctctcccaggccatgtcaccttgttcaagtagaacatttattcctgcccaccacaggcatttgactctctggaattcatgggaggttctagagtgcgtccggctctgtgtcaactaccactgtgcaattcctgcaaaggcagttgaggcgggggtggagtagccctgaataaactgacagccagaggactgggatatcagctgagaacgttcccatggaaaagaaaagtccagccccttccagcaaatgctgcctggctctgcaaagagtgccttgtcatctcattggcattgcttctgtatttctttcctatttcagaccagaagtgagtgcatggaggatctctgtgagctggttttctctatcttcaggataatccaacctttagtaacaaaagcagaaaaatctattcctatcctttggctcccaagtccacatctaagtgattcgtcctaaggatgtatttccaaaattgtttttaaatcttgtttcaggccaggagcggtagctcacgcctgtaatccctgcactttgggaggctgaggtgggtagatcacctgaggtcaggagtttgagaccagcctggccaacatggcaaaaccctgtctctgctaaaaatacaaaatttagccacgtgtggtggcggacacctgtaatcccacctactcggaaggctgaggcaggaaaattgcttgaacccaggaggcagaggttgtagtgagccaagatgatgccattgcactccagcctgggcaacagagtgagactgtctcaaaaaataagtaaataaataaatctttttttaaataaaggttgctagtattatgcatgattacataaagtggggcctacccaggtcccaaatgacaggtggatgagcaaactttggcccccatttgaaagaatactatgataagcttaaaaatgacaaaatgaaattcgtcaaaatatagaaaagtatatatgaaagaatgtccagggaaaatattggaaacccaaactgcacaaatcaatcagtttctccctgcagccctgttgatgaaaactggaagagttcaagaaatagttatgtaaaatttaaataaagtccatgttcttttttgtgggtatttgtgtgcttaagtaatgtaagtatcataatccctaagaaaatactttctaacttttaaacattgttcactataaaattatcattcactttcttcaaaaaataataaattattttaataattgctaattgctctgtctagagttaggtggttgggatacagaagtaattgcttcctggcattcaggaaagtacgggtcttgttttgaccaggcctctgccttcccagggttactccaggaattgggatctagaacagcatatgtttacacccaaaggtgggagatcactttctcaggcaggactggtcctggactagggaaaactactcatctagcccaaatgacttgtccttccaaagaaactattctgctcccccaactaataatattagccatatcaagattcttagctgcaaacaagaaaaaatttgccatggatagttgcataacaatgatcattattatcatcacttttggtgcagttgttgtatgcaggcactgtgctgggctcaatgggaagggttttatgtgcattatctctttttatcaacaacctagaaaagaaggcaattacttcctgttatggatgaaggaactgaggctaagaaaggctgagaaacttgcccagagaccacagatttagtaagtggtagaggagattttcaaagctagagctgactgccaagcttgaggtcttaacaagcttagtttctgcaatgaaaatcctgctgggcttcagtgagaatccagcaagctggtgatgcagcctccatccttggtgggcccctactagccttaatatttcagggcagtttccaggagagctggctggagtcagtggttggcatccacacgcagcagagccatgaagctggctttcccagcagctcacattaactggcagtggcagccaaggcaggtcagaagcagaaatgctctcagggcctcaggaaacatctgcaagtcctcaaggagacaagacctgcccccttatcacctcttcgggggagagagtgggcctatcccatctgcagggaaagaatgaacacattgcttttattttccaaggtgtgttcctgtaaatgaaacaattcactgctatgcaacttttaggattggccacttgagagcaggccttgtactggacaatggggtggcagtcctgaaatcagagccaccacctgcctgccagggcttgtggggcaagggtgaagatggtgacaagtgacaagcagtatttgcaattcaaagtgaatggtgcaaggaaaaggggatgtggtgtaagggggagagtatgaactttggagtcagaaagttctgtttcttcatgtcctggttgtgagactttgggcaaatttcctaacatctcgaggttgtttcctcatctggaagaaatgtaaatagttatacttgtattgcataattaccatgaacattaaaaggtacaagtatatcaatacttaaaattgcctagcagataatgggagctcaataaatgataacattactagtgttattaaaaaggctcagttggaggatctataaatggtgttgttgaaaagaaaacagaagggacatattagctgggttttgatggggaagtaggagtttgttgactagctggtaggcaggaagggttttctagttagcaacttagcaaggacagctttgtgaaggagcatggaacatccaggcaacatgagtggaccagttaggagctactgaaatattcccatcaaaatacaggggcgtacccctggggcaagatgactctctgacgtccacttactactattctcaaataaaggaccatgaacaacctctccgtgtaaattcataaaccagcattcttgttagctacgcttcctgaaatggagcagcctccaggcccatggcctgacaatccacagggaacaaacaaagctgagaatcagattccaagagcccacgctcttccttctctggagttagacaggcttgagttttcattcctgtccttgctgtgtaaacttggcaagtcactcatctctcttatctttcagttttgccatctgaaaaatgggaataattatacattacacagaaattgttatacattatcacagtacctggtgcatggcaggtgctatctattctttagagaaaggagctgctttcttgcctgaacttatggcagagtgaaggcaagactgacatattctggaagaagccccacaatctcgaccatgaaatatcaaaaaaagactttcacaaaaatggcataggatagatgttattctgtactttgcttttttcaatgaataatacaacatgtgaatacatttagatctttctctctttttttttttttggagacggagttttgctcttgtcacccaggctggagcccaatggcacaatctcagctcactgcaactttcgcctcccaggttcaagcggttcttcagcctcagcctccggagtagctgggattaccggcacctgccaccatgcccagctaatttttgtatttttagtagagacggggtttccccatgttggccgggctggtctcgaactactgacctcaggtgatctgcctgccttggcctcccaaagtgctgggattacaggcgtgagctactgtgcccaacccttctcttttttaaaaattgagaattttacagtattattacagtattaaagctcacccttttaaagtgtacaagtcagtggtttttagcatattcatgaggtctttcttgcaatcatcactattacctaattcaggacaatttcatcatcccaaaaagaaaccctgtatctgttagtaatcatgccccattgcccccttcccctgcccccaaggactgcttatcttattttccatctctatggatttgcctattctacacatttcatacaaatggaatcatattatatgtggccttctgtgtctaatttattttatgtagcgtaatgttttcaagattcatccatgttgtagtatgtacctcattcctttttatggctgagtaatattccactgtatggatataataccatattttatttatctattagctgatgagcatctaaattgcttccatttttggctattataaagtaatcctaatttctttaagtagttgccttgtattccattaattagaggtagcatagtttagttaagcacttcttactgaaggatagttctggtcttcttcattgtttgctaagcaaagaaagatattgttaccacaacatccttctagtctaagagatagtcaaaacttaccccatttcctgagggaattatccaacagaagcaaaaagttgtattgcaaaatatactaattgcagcaatttttgtagtaacacaaaattgggaactacttaaagagtccacaacaaggagctctttaagtaaattctattgttcaattaaataatgtacaattactaaaatgataactatgaaggcaatatagcaacaagtgaattgcaaatggtgatcttaagtggaggaaaaaccatgacaaaatgcaaaatggcatcccttgcccacactggttctcgcgatagtaagaagtagggctgggaagcacatccatgccctctggccttgaaattcctgtctctgccatgtcacaaggaggaacagaatccaggcttcctcactaaggagcaggctggggatcactgccaccctacaactactgtgggttctaggagagggcccgctcaggagaaaggaaggctcccctcccacgtgacgaggggaagctgaagtcactgttgccttccctagattttgaaggtcctgactccctaggtccccagggagtgggtcatagctaggctgtataatggtgacgagaattgtggacccaagtcatcctggtggctgtggaaccagttgttcatgaagatagtgggtgaactgttgtgatgagtaccttccaaacttcctgtgtgtggtgctggggtctcttgccaacgtccaatacctaggacaaatgctgacttctcagagtgccacctggcactgtactttccagagtagtcattgcaactacattcaacagcagtaactgtgaatccattcaattgaaccaataatgtgaaactgttatttatttatttatttataagatggagtctcactctattgcccaggctgcagtgcagcggtgccatattggctcatcgaaacccgggttttgagcaattctcctgcctcagcctcccaagtaattgggattacaggtgtctgccacaacgctcaactaatttttgtatctttagtagagacggggtttcacatgttggccaggctggtctccaactcctgacctcaagtgatccacctgcctcggcctcccaaagtgctaggataaagatgaaacccaccacgcccagcctgaaactgttttttaaaagtatccttcctgcctgtaatcccagtactttgagaggccaagggggtggatcacatgaggccaggagttcgagaccagcttggccaacatggtgaaaccctgtctccactaatacaaaattagctgggcgtagtggcgtgcacctgtagtcccagctactcaggaggctgaggcaggagaatcacttggacctgggaggcggaggttgcagtgagccatgatcacgctactgcactccagcctaggcaacagagtgagaccctgtcttaaaaaatagaataaaaatggccaggcgcggtggctcatgcctgtaatcccagcactttgggaggccgaggcgggcggatcacgaggtcaggagatcgagaccatcctggctaacatggtgaaaccccatctctactcaaaatacgaaaaaagaaaaaaaaaattagccggccgtggtggcgggcgcctgttgtcccagctgctcggcaggctgaggcaggagaacggcgtgaacacaggaggcggaggttgcagtgagctgagatcgcaccactgcactccagcctgggcgacagagtgagactccgtctcaaaaaaaaaaagaataaaaataaaaaaataaaagtatgcttcttattgtcatgatcatgtaaaccacaatcattgccattaaaagtacacaatgtagcaaaaccagtgataacctgtagccttcaaagtattattaataagagaaatttatcctcaatggagcatgttggttggcagcttatttttttggatacttatagttgtgatgtttacgttgtgattttgtattttgtatcgaccataaattatatttttttatttctaaaccttgtaaacaaaaaatatactaacacagaattttgttaaagtttatatgaaggaatataaaaaaaaaacattttctagtattcaggaaagtatatagtagcttcccagtcctctgctaccagcttccaatcagctccacaaactgtgaaactgtccctaaaatgtccccagtcttagggagaagtttgagattattagggtcacagctacactgctgtaacaaagaggccccaaaatatcgtgggtgcaaaaacatcaaaattaatttttctcttacaaaacaaaacaaccaggctggattggtcaagtgatgccgccataaacagatacagtttcagccaggagcggtggcacatgcctgtaatcccagcactttgggaggccgaggcaggtggatcacctgaggtcaggagttcaaggccagcctggccaatatggcgaaaccccgtctctactaaaaatacaaaaattagcagggcgtggtggcggacacctgtaatcccagctactcgggaggctgaggcagggagaattgcttgaacccaggaggcggaggttgcagtgagtcaagatgatgccactgggctacagagcaagactctgtcaaaaaaacaaaaaacaaaaaacaggtagtttccctgttggtctccatcccctaaggtgtcattatttgcttaatcaaggctgggttgctaactctgggaaaggaggaagaaccaacattccagataaggagcttaaatctggagatgacccagaaaatgttcacatcacttcctttcaatatttggttagtccacacttaaccacatggtcacatccagctgcacaggagtctaggaaatgtagcctgtagctgggcaactgtgcccaggaagaggggaagaatttggaggaataagtagccatctgctacagagattctttttaatttaaaaaatttacaacataaaagaattatattacaatcccatcatacaactactgacatttttctattgttctttccacatttgaaacatgtgtgttccatgtatttttataaagttgtaaaaatagtatgtatgcaattttacattctaccagaaataaaacagtataatgaaaataacattagattcaaacaatgatatgctatttttttacctatgacattggcaaggtcttttaaaaaaccacaataaccagtgttggagagatcatggggaaatagccactcaaacgttactcatgagagtgtacacatgtgtaacttcacttggagggcaatttggtgatacatttaaaagttttggccaggtttggtggtgtacacctgtatccccagctacacggggaggctaaagcgggaggatggtttgagcccaggagtttgaggctgcagtgagctacgatcgcacgactgcactccagcctgggtaatggagggagacactgtctcaaaaaaaaaaaaaaaaaatttacaatttaacctaaggggaaaaatgtagagatgtgggtacagatttgtataaaggctggttgtcgaagccttacttatgctaaaaaatagaactaacctaaatatccaatggggattgtttaaatgaattatgattcaaccttccacagagattagaatcatgctcttgaagaacactgatgatgtaaaaagtctgctaacatattaagtgagaaagcacattacaaaatggaatatatgttctgataatttttggtaaaaattatccatagctgtaaagaggactagaagaatattcacccaaatgtcaacagtggttcttctgggtgagtgctattgacagcggtttttacttccttatttactccttttgatatttttcaaatatttggcaatagacatgtattagttttacaataaaggggttatttaaaacactgaattagacatacagaatcctaatacattagagcagaaatgatccttgaactccttcatgtttcaaatggggaaactgaggtccagagagggtgagtgacttgctaaagtaacacaactagttagaattgagatttgaactgaagtagtttgtcttcaaggctggtgttcttatcactatataactaaaaaaaaaaacaaaaaaaaacacctttttttttctttttctttttgtagtcaatgttctgctgaataaaaagaacttttctaaaaacagcttgactcctggcagcttagtcagtgttgaggtacacaaaaaaacaaagtgtctgtaagtccttggagaacttaaaacaaaacaacttaaaacatacacacacaacaaatttctggtacatccagtgcttataaggaaatatacattgggaaaacaaacattcacactgatagaaacaggatatgagtgtctcattcattcattcaaaaaatatttgttgcgcacctactacatgctgtttttaacacactagatcctggtaatcaatggtaaacagacatgattctcactcttctggtgcttacagtatttaaattctgctaatgtttgttgaacatctactatacactttacatatttttaaagtttttttcaatatagagatgggggtctcactatgttgcccatgctggtctcaaactcctgggctcaagtaatcctcctgccttggcctcccaaagtgctgggattacaggcatgagtcacgacacctggccaacgctatacattttttacaaacctttgtcattgtactataccaataatattaacccccactttatgagttataatttagctactaagcattgtaactaggcactatttctaatcttacaacagccctatgagataggtatcattaactctatttcacagatgagagaactagaatcatagatattaagtggatttcccaagattacacagactaagtgacagatctgttttctaatgctcatctcattgcccttaaacatagggtcctcttcccacaactgtagcctcaacctcgagcacccactcattacagaggttaaataaagggctaggacttaatgaatttagaccatttcagacttattgaacttattgggatggagcccaggaatctgctattcttttattattattattattatttatttatttatttatttgagacggagtctcgctctgtcgccaggctggaatgcagtggcggatctcactgcaacttctgcctcccaggttcaagcgattctcctgcctcagcctcctgagtagctgggattacaggcatgcgccaccatgcccagctaatttttgtatttttagtagagatggggtttcaccatgttggccaggatggtctcgatctcttgacctcgtgatctgcccgcttcagcttcccagagtgctgggattacaggcatgagcaactgcgcccagccaaatctgtcattcttgataagatcactctataacttgtatctgtgctaaagttcaggggccaccgcccttatctgtaacctggaatcctacaattcaatctcccattagagaatgtatccttaggtctcaggtggaatgtaccaattctcaaattccactaggggacagtataggccaatatgtctagacaagtggcacactgtggaagactgtggaatcaatcactgatgacattcattcatccctggaccaacagcgagggcttgtcggctgccaggcactgggctgagcaaaggtggatgatttctgtaatgctatttacaaacttagaaagctgctttggggccagatgcggtggctcaggtctgtaatcccagcactttgggaggccgaggtgggtggatcacctgaagtcaggagtttgagattagcctggccaacatagtgagacccccatctctatattgaaaaaactttttaaaaatgtataatgtatagtagatatccaacaaacatcagcagaatttaaatactgtaaacaccagaagagtgagaatcatgtctgtttaccatgaattaccaggatctagtgtgttgaaaacagcatgtagtagatacgcaacaaatattttttgaatgaatgaatcaatgaagtactcatatcttgtttctatcaatgtgaatgtttgttttccagtgagccgagatcgtgccactgcactccagcctgggcaacagagtgagactccatttcaaaaaaaaaaaaaaagaaagaaggctgctgtggagtaatgtggtatgttgaaaagcaggaccacggtgttttgtggtttctcccatcaaaaggtagatctatttcctcacgccttgattctggacttgctttgaccaagagaacatggtagaagtgacttgcagagttccagagcctagacctcaaggtctcactgcttctccctttgctttcttgggaggcttctggcattgagttcagaagcctaggttgaaaggccatgcagagaagcccagctgtcccagctgaggccccagcctcgtggataaagctgtcttagcccacatattcccggaccagccaccagtgattgtaagctgcctggtgagcccagcagacccagtcaacccgccaaattgtgaaaaataacaaatcattattttaagccactaagtttcagagtagattattacacagtaatagataactgatagacgcggccatgcacaggggattttttaaattaatttagcaattctttaactgagtgcctgctttgtaccaagtattgtattatctcacgtgttagggatctgtgccttgtggaacaagatagaaaaagcccccagcctcatatgggcgaagacgcacaataaattagtaaatggatagatatacggggcagtataataccatatggaataagggctgtgaagaaaaacaaagtatggagttcaagaatgattgagggtcgagatcaggttcttatagacagagtggtcatggaaatcttctctagaaaggtgaaatttgaggatagctgtgagtactgagaaggagcaaaacctgtgaagatccaggagaaacacttccatttcaggcaaatggaacaatatctaaaaaactccaaagcgggaaacatcttagtatacgcagagtacagcctgaaggccagtgggatttgttaaatgcaatgttaaatgcaaattaatacaaatttgttaaatgcaactgtcaaatgtgaattaatggtttaacttgttaggccgggcatgatgggtcatgcctctaatcccagcactttgggagactgaggggggcagatcatgaggttaggagttggagaccagcctgaccaacatggtaaaaccctgtctctactaaaaatacaaaaattagctgagcgtggtggtgcgcacccatagtcccagctactcagcaggctgaggcaggagaatcgcctgaacctgggaggtggaggttgcagtgagccaaggtagtgccactgtactccaggctgggtgacagagtgagacttcgtcacaaaaaaaaaaaaaaaaaaaaaaaaaagtttaacttgttaaactggtgtaagataccattttaacttatttaggattccctatacttcaattttcttaacactaagaacagggtcatgtcagtcactcacattcactgaatgctaactcaaatgaatatcattctaaactatttgtcaaaatatgtttaaaagttctttatttttctggcttttgaatcagtaaactattttacacttttctgtagctcttattgcctttagtgttacgatgctcagaatctaatcttcagatctagactacctcatcaaagaacactacgggagaaaatatttgcaaactatacatctgacaaaggtctaatatccagaatgtacaaaaaacttaaacaactgtgcatgcaaaaaacaaacaaccccattaaaaagtgggcaaagagtatgaacagacactttcaaaagaagacacacatgcggccaacaggcatatgaaaaaatgctcagtatcactgattgttagagaaatgcaaatcaaaaccacagcaagataccatgtcacacaggtcagaatggctattattaaaaagtcaagaccaggcgcagtggctcacacttgtgatcccagcactttgggagtccgaggcgggtggattacctgaggtcaggagttccagaccagcctggccaaagtggtgaaaccctgtctctactaaaaatacaaaaattagctgggcagggtggcggccgcctgtaatcccagctactcgggaggctgaggcaggaggattgcttgaacctgggaggcagaggttgcagtgggctgacattgcacaattgcactcgagcctgggcgacaagagccaaactctgtcttaaaaaaaaaaaagtcaaaaaataacagatgctggccaggttgcagagaaaagaaagcacttatacgctgctggtgggagtgcaaattagttcaaccattgtggaaagcagtgtggcaattcctcaaagaactaaaaccacagctaccatttcacctggcaatcccacagctggatagatatctaaaggaatataaattgttctaccataaagataaatgcatatgtatgttcattacatcactattcataatagcaaatacatggaaccaacctaaatacccatcaatggcagattgggtacagaaaatgtggtacatatacaccgtagaatactatgcagtcataaaaaagaacaagatcagctgggcatagtggctcacgcctgtaatctcggcactttgggatgccgaggcaggtagattacctgaagtcaggaaccaaggcaggagccggctccctcagcttgcagggaggtgtggagggagaggcgccggcgggaaccagggctgcccactgtgcttgtgggccagcgcgagttccgcgtgggcgtgggcttggcagaccccgcattcagagcggctggccggctggccggccctgccggccccaggcagtgaggggcttagcacctgggccagcagctgctgtgctcaatttctcggcaggccttagctgccttcccacggggcagggctcgggacctgcagctcgccatgactgagcctccccacccctccgtgggctcctgtgcagcccgagcctccctgacgagcgctgccccctgctccacggcgcccagtcccatcaaccacccgaaggctgaggagtgtgggtgcacggcacgggactggcaggcagctccacctgcagcccgggtgcgggatccactgggtgaagccagctgggctcctgagtctggtggggacttggagaacctttatgtctagctaagggattgtaaatacagcaatcggcactctgtatctagctcaaggtttgtaaacacaccaatcagcaccctgtgtctagctcagggtttgtgaatgcaccagtgtacactctgtatctagctactctggtggggacttggagaacctttctgtggacactctgtatctagctaatctggtggggatgtggagaacctttgtgtctagctcagggattgtaaacgcaccaatcagcgccctgtcaaaacagaccactaggctctaccaatcagcaggacgtgggtggggccagataagagaataaaagcaggctgccggagccagcagtggcaacccgctcgggttccctttcatgctgtggaggctttgttcttttgctctttgcaagaaatcctgctgctgctcactctttgggtccacactgcctttatgagctgttaacactcaccgcgaaggtctgcagcttcactcctgaagccagcgagaccacgaacccaccagaaggaagaaactctgaacacatcccaacatcagaaggaacaaactccagacgcgcccccttaagagctgtaacactcaccgcgagggtccacggcttcattcttgaagtcagtgagaccaagaacccatgaattccggacacaccgaggcaggtagattacctgcagtcaggagttcaggaccagcctggccaacatggtaaaaccacgtccctactaaaaatacaattagctgggtgtggtggcgggcacctgtaatcctgctactcaggaggctgaggcaggagaatcgcttaaacccaggaggcggagatcgcagtgagctgagatcgcaccactgcgctccagcctgggtgacagagcgagactccgtctcaaaaaaaaaaaaaaaaaaaaaagaagcctctggggtgaaagaaatctttctgcaatgatttctatacttaggggcaaggagggaagtgcctgcagcctgggtgaagggctgatggaggtggcagagagagactacaggccaggaaggtcagctgttgctcacccaggtgttgtcttgggacaatcacgacctacttcctacttcttccctttagaaaccatcagcatagccaggccacctgaatcagtcttccaggaaagcaacatgccctaataaggagaaaagttaagtgaaattagagattatttcccggaaagatgcctcctatcactgctggttgtttagtataaatttaagggcaaatacctgaccagaggataactctcacctagaaagatgtgattagaccagagggatcaagaggggttttgggagccgggcggggtggctcacgcctgtaatcccagcactttgggaggccgaggcgcgtggatcacaaggtcaggagtttgagaccatcctgccaaacatggtgaaaccccgtctctactaaaaatacaaaaaaaattagccgggtgtggtggtgggcgcctgtagtcccagctactcaggaggcagaggcaggagaatggtgtgaacccaggagacggagcttccagtgagccgagatcgcgccactgcactccagcctgggcgacagagcaagactccatttaaaaaaaaaaaaaaaaagaagggttttggacaggtgtggtggcttacgcctgtaatcccaacagtttgggaggctgaggtgggaggatcctttgaggctaggactcgagaccagcctaggcaacacagtgagaccctatctctacaaaatacaataaaataatcagcctggtgtggtggtgcacacctgtggtcctagctacttgggtggctgaggtgggaggattgcttgagcccagaagttaagggtggcagtgtgctgtgatcacgccactacactctggcctgggcgacagagactctatctcttaaaaaaaaaaaaaaaaaaaaaattcggggggcactctgtgaccagggcttatctccttctctctccttaaacccagtgggagagacagactagagactggtcctcagcccttcccccagaagttgccatgcagagtggctgataccccaggggaacaggagctcattgaccaaactaattagccacctgaggagtacaaacacagtaaaaagaggacaacgaacatctaccatctgaagcaaaattattggaatagaccaaccaagaacatgcacggtaaataaacttaggaaaataaagataaagcaagaacaagaaatcattctgtaccactttaatgaagtatacttaacatacgatagactacacatatttaaaacattcaatttgatgagctttgacataagtatacacctgtcaaaccatcactataatcaagataatgaacatctcaatcacccctaaatcttcctgtacccctctgtcttagtctgttcaggctgttattaacagaatattatagactgggtggtttataaacaacagaaatgtatttacttatttacattttattttttgagacagagtgtcattctgtcactcaggctggaatgcagtggcgcgatctcggcttgctgcaacctctgcttcccgggttcaagcaattctcgtgactcagcctcctgagtagctgggattacaggcacccactaccactcccagctaacttttttttttttttttctagtagacatggggtttcaccatgttggccaggctggtctcgagctcctgacctcaggccatctgcccaccttggcctcccaaagtgctgagattacagatgtgagccactgcacccagccaacaacagagatttatttctcacagttctggaggctggaagaccttgatcaagatgtctggtaagggccagcttcttcatagacacctgtcttctcacagtaacctcccaggcagaagagggaaacaaactcactgagtctcttttatgaggacactaatcccattcatggaggctctgctcttaccatctaatcacctcccgaaggcccacgtcctaataccatcaccttggaggttaagatttcaatatatgaattttggggggacacaaactcagaccatagcacctttgtggtcatcctttccttcagctccatcccagataaccattggtctgctttctgtcactggagattgattttatagatataattttgtataaatagaagcatatagtgtgcattctttttatcaggcttattttactcagcatcataattttgaggttcactcatattattgtatatattgataatttttccttttattgttcagtagtatttctttgtataaatagatctcaattatacatccatttatctgttaatacacatttgggggtgtttccagtttgggggtattacaaatgaagctgctataaatatctaggtacaaatctttgtgttgatgtatgggtttttttttttttttttttgagacagggtctcactctgttgcccaggatggagtgcagtgacgcaatcttggctcactgcaacctctgcttcctgggttcaagcaactcttgtgcctcagcctcccaagtaagtgggattacaggtgcatgccaacactcctggctaacttttgtatttttagtagagacgggtttgtgccatgttggccaggctgtgtgttgatatatgtttctatttcttttggattaaaaaaaagctaagactggaatggctgtgtcatatggtaggtgtctattaaactttaagaacctgccacatatttttccaaagtggttgtgtcattttgcattcctgttagcagtgtatgagatccccagttgcaccacatcttctctagtacttggtttggttggttttttaaattttagccattctatttagatgtttccctgttgactaatgatgttaagcatcttcttaagttcttattcaagtatcttcttttttttttttttagacggagtttcgctcttgttgcccaggctggagtgcaatggcgtgatctcggctcaccgcaacctccacctcccaggttcaagcgattctcctgtctcagcctcccaggtagctgggactacaggcatgtgccactacacccagctattttttttgaatttttagtagagatgggtttcaccattttggccaggctggtctctaactcctgacctcaggtgatccgcccgcctcagcctcccaaagtgctggaattacaggcatgagccgtcatgcctggccctgtctctttcaatttatagattcttcctccacccctttcatttccttagaatgtatctgttgaaaaacccaggccatttgctacagtttcctgcagtctggattttgctgattttatactcctgttgcagttcaacatatttctctatccttggtatttcctgcaaattggtacctaagttcagagaatggttcaaactcacgtttggttcctttggcaagattactgagggtatttggcatgactataggagacacattatgatttgttgtctctttgtgatcttaggagtgggtgaagctcaatgcctatctattcattcagaggagttgcaaactggttatattctatctttttcccatttagagttggaatacttttattaagaggaatttttccccatctactatttggatgcccaaataatatttgctttttatttaaagtttaataagtttaatggaatgttttaatattggtcactcagggtgtatattctcttggtatactttcaattgtagtttcaacatttttaaatttctgaaatgttttcttgaattatatcttttggcatttgttctgttcctcccttacttgattttcttctttaggaactcctattacctgtatgtttgatctttgctgctttcaatatttgtcaatttccctcaaatcttgtttatctcttcatttcctttttatttaaacatatctttctttttcactgtcttttatctcttaaatcattatctgtttatctgttattattattatttttgagatggggtctcactctgttgtccagcccggagtcagtgctcaaacatggctcactgcagcctggaccttccaggctcaagtgatctttccacctcagcttcctgagtagctgggactataggcacatgccaccatgcccagctaattttttttttttttttgtagagatggggttgcatcatattgcccaggctggtcttgaactcttgggctcaagtgatcagcctgccttggcctcccaaagtgctgggattacaggtgtgaaccaccatgcccaggctgatgtatttgtttttaagttagtcttggtctgttttatggtgtctccctggtgtgttttcattgtctgtaaggatgttaatctgctccttcttcgcatttttttcttaataactgtgtatagaatttgatcttgatacttttatattatttttatgtaaaatttgttttcctgactttttggaatgagtgtatgttcaggcaagcttttcaaccttctcagagcagtccctcttctcttatgtatggattcaaacatattgcaagttgctttctggcatttcctgcctctgtctttatcctttcttgagtctgggccatctcttactttcctctcttgtccctgtcctgctcccaggagttttagccccaggagttttccctggtgtggggccttgtcctaaaagagagccgatcagcctcaactgtttataagggctacagtgctccagccctttcaggcgttcttgccttaggtccttgttctcatccactgttggagagcctctcccagcttcagctgacattttaggattggcagcccaactctccattgatcacctgttgcctattttggattctcctgttctcaggcctctcatatactatctcttttccttccttcattttcctcctacaaaaatgttcttgtggcaataggtatttcgcctcaactactgtattctggggctcatgaagttaccttgtacctagctttgttgaaagtactgtctgggcccttggttttgctattcagttgctgggttttttgtttgtttgtttgtttgtttgagacagagacgcccaggctggagtgcagtggcatgatctcagctcacagcaacctcccaaactccgcctcctgggttcaagcgattcttctgcctcaacctcccgagtagctgggactacaggcgcataccaccatgcccggctaactttttgtatttttagtagagacggagtttcaccgtgtcagccaggatggtcttgatcttctgacctcgtgatccgcccgcctcggcctcccaaagtgctgggattacaggcgtgagccaccgcgcctggcctagttgctgttctttgtgtggatttgaagagattaaaaaccaggctggcaccaccaccaacctgctcattttgtgttttcagttgtttaatgatttttgccttcaagttctagcagtgtcttctgtgttcctatatttaataaagacccgatgagtgatacagttccaccaaccatgcatctaggttagcaacctagagccagcaaacaaagagtatcagtttatagaaagtctgtatctagaatccttctactagcttacaaatctcttggagagttacttcctctatggaaccttggttatcacccttaagtagaacttcttccttcttggtgcttccttcatgacacctcttgggttttgtgtgtgtactatcctagggaacctgagctcccagaaacagtgaccatacacgattaatctacatatccccaggctccagcacgatgcctgatacagagtagaaacctcatacgtgtttcctgaaagagggagtttgagctaaaagatgcctgcagctgtattatataactaaaaaaaaattaattattcttaaaaaaactcatgctcggccgggcgcggtggctcaagcctgtaatgccagcactttgggaggccgaggtgggcagatcacgaggtcaggagatcgacaccatcctagctaacacggtgaaaccccatctctactaaaaatacaaaaaattagccgggtgcagtggcaggtgcctgtagtcccagctactcaggaggctaaggcaggagaatggcgtgaacccaggagacggagtttgcagtgagccaagatcgtgccactacactgcagcctgggcgacagagcaagactccgtctcaaaaaaaaaacaaaaaacaaaaacaacaacaacaaaaactcatgctcactgtgggaaacttagaaaatacaaaaataagcaaatagaaaatatttttctcattcttttttttttgagatggagtctcactctgtcgcccaggctggagtgcagtggcttaatctccgctcactgcaacctccgcctcctgggttcaagcgattctcctgcctcagcctcccgagtagctgggactacaggtgcgtgccaccacgcccggctaatttttgtatttttagtagagatggggtttcaccatgttggccatgctggtcttaaactcctgacctcaggtgatccacctgcctcggcctcccaaaatgctgggattacaggcatgagccactacacccagcagacgtgcatgtatctttatggtagaacgatttatattcctttgggcatatacccagtagtgggattcctgggttgaatggcagttctggtttttaagctctttgaagaatcaccacactgctttccacaatggttgaactaatttacactcccaccaacagtgtatatgtgttcccttttctctacctctccaaagttcattcttttttttctttgatacgacaaagtctcactgtgttgcccaggcaagagtgcagtggcgtgatctcggctcactgtaacctctgcctcccaggttcaagctattctcctgactcagcctcccaagtaacgaggattacaggcacctgctaccatgcccagctaatttttttttcgtatttttagtagagacggagtttcaccatgttagccaggctggtgtcaaactcctgacctcaggtgatccacctgcctctgtctcccaaagtgttgggattataggcgtaagccaccaggcccggtcaaaaaaaaatttttttttttttttttttttttttgagacagagtcctgctctgtctcccaggctgcagtgcagtagcataatcatggctcactgcaacatatgccttcttggctcaagcaattctcccaccttagcctcccaaatggctgggactatgggcgcatgccaccacgtctggctaatttttgtattttctgtagagatggggtttcaccctcttacccaggctggtgtcaaactcctgggctcaagcaatccaccagcctcagactcctagagtcctgagattacaggcctgagtcactgcacctggccatgttattttttgactttttaatagctattctgactggtgtgagatggtatctcactgtggttttgatttgcatttctctaatgatcagttattgagcttttttaaatatgctttctttggacacacacatgtcttcttttgaaaagtgttcatgtcctttgcccactttttaatggtttttttttcttgtagacttgcttaggatccttacagatgctgaatattagacctttgtcagatacatagtttgcaaatattttctcccattctgtagattgtctatttactctgttgacagttccttctgctgcctactgatgtcttagcatgacatgccctatgataactggaaataaagtagaaggcaagtacagtattagaacacatttaggctgggtgcggtggctcactcctgtaatcccagcactttgtgaggctgaggtgggcggatcacctgaggtcaggagtttgagaccaccctggccaacatggtgaaaccccatctctactaaaaataacaattagctgggcatggtggtgtgcgcctgtaatcccagctacctaggaggctgaggcagaattgcttgaacctgggaggcagaggtcacgccactgcactccagcctgggcgacaagaacaaaactcagtctcagaatgtgcagtaaccttaagtgcaagaaagtccttggtataattaaacgtcttctacagcaacggaatctggctctcattactagctgcaactcccaaattttccactaggtggcagaacaggctagataatagccgggggttctcaaccttagtgggcatcacaaacacctgtgggtcttcagccccaaagtttgattcattaggtctgggtgtggcctgataattagcattcctaacaagcttccaggtgatgctgatgtttccaggtgatgctggaaggaaagtacattttgtgaacactggattacagaaaatcaatgtagaccaacccaaggcccattcacccatccatccatccatccatccttcctccagtttactttgtagttctaggtgatgtgagcacagagaagaatgagacatggtttgttctcaagacatagtcgggtgagggagaaaaggaaaatgaaaaaaataactcttagtctattatttccacctctccatttcttccaatatacagacttcctaagtgttgtttttctcttcttctgtcaaatagagtttaagccttgtgcccttaaagcctgaaagatcaactagcccaagagctgccttacatggctaaacctgctgaactaagaaactcaggaatgtttgctatcctataaaaagtttcagatagaaaatctcctctctgaacttagaagctggagatataaaagcacacctgacaccctcgagtctgcattgagtaaaaataaaacacaggattactatgttcttagaatctgtgcttggctgctttccaaaatgaattcctcattttaaacttcaatatatattatggttaatttggggaaaaaacattttgactcatgactgtccatattttcctttaaatagtattgttgactagctctaatctttggtactgggtcttactagatctactttttgcataatttgtgatgtaccatataaaccagtaatatgtaaacagattgtgtataggtttacttgacacaaatcctttttatgtaatgaaagaacacttcaacgcatgtcttgggttgaactattatttctaaatcagtgataattagattagtgaaattttatttatagccataattcatctcgaccaatgatttcacaagtatttgaaagtgtaatgggtaaaagatgcagacagaattcaagagatacaaataagcacacataaaaatatgtcattttctctctagtcccctcccccataaaaatgttgtcatgtgttaaagaaatgtcagttaaagcaaccttgagatacttcctttatatctattaaattggcaaacatgtttagaaatgttctttcttgactcgggcagtggttagacaagtgttcacttcataactattcgacaaaactgtgtgttgtatgcactcttctgtacctgtaacagaaaatactaagaaaaaattccactgcttttgcgagtaagtcttctactggaacttgttctaaggaaatatgcacaaagaagttctctgtagtatcttctaaaaagcagaactggaaactacctaattatctaccaaaacagaaatggtttagcaaattacagtaatgaaggaaaattacaaaatattatggtagttgtaaaaacctaaagcacatttttgagaatgtattacaaaacaatgatttgcagtacataaatccatacacatgtgcataaggattagaagagagtattaaaaatcgtaatgataaaggagctctgggtaattttctccataagtttttattactgttagattatctttaccacagagagcacagaacatgtggttaaaatgcaaaggacaggaacatcccactggcagggactactcatgtctaatcacagtgtgatcattaaatattctctccaaatgtactcagaacacttcagatgtttacaggatatggcagaagagggacgtctaagagaggaaaagctgtgtggaattgatctttcatttgcttctgatcttttattttcaattttagatgctctggaagttatttttcttccaagtttagatagctcttaagacaatccatggaattcattaaaatctcaatgaattcctactctcaatcttacaatgttgctggggaaaccaggtattcacttgtattttggaaaaaactgagaatcaaggatgaaagttaatagttgtctactgcaaaaggtacaacagtatttattgctaaatgaactgcaccactaaccttacacaaaaatgctcagtgaggctggagtggggtatggtggtcagcagaggctttaaagatagtgggagatcaatgggattaaagcctggccctaggactggtggaaaggaacatcaagaactttccacgaggatgggagattaacacccaaagcgcaagggtggaaataaatagaggagcaagaactgtttgctcgaagaaattagctagggctccatgatgttaaggaatccagatgtgccctgatggtaacggagagttaccaagattgaacaagagcaagtaagtgctcaaagaagtggttggggagactccctggaagcaaagcataagacaggttgaacagtgcacacaagtggtgaaggcagaaggcagcagtcgggatttgaagagacttgaaatacagaaagaacagacaaacatgaaaacatggaaaaaatccaggtgtgtgggggctgaaaatcagggcttcagcctcaccacttactataactcctctaggcaatgaatcactttaccaagccacagctttctcatctgtaaaacaggaatgacaatctgcccttaatgatgctgtcaggggatcaaaggtgcagggccgtggtactcaaatgacaagaagccccgtaagtttaagttagtaagaaagaactcatgcaaagatgtgctggatagacacatccttgggcaaaagagaggaagactattccaaggtctggaagcaaaatgggacttttacccaccccatcccttcatttgcaactattcatgaaattcaccaaaattatttccttgtgttttacctttattgttttgctttttggatcaccttcagaaatggttatattgttgagtttaccttctagaagatgcagaaacagtaaaaaaacagagccacctcagatcactcaaggggttgttctattttcaaaaacacactgacttttgaaaagtccctgcattggttggataaaatgtctgaagtggttggggggaaagcaagacaaagtcttaactacagaatatatttttaaggaaatgcagctttattactttcaagtacaaacaataacttgggcttggctaaccaaatttgcctaattgagggaatctgctttaatgtacagatataaatgatttatagttaacacaatcactcacgggtaaaaagagtgcttctatgatgcaagaaaataacttctcatcttagagacatcttgttccacaatcaccccactatttgcttaagcaacctcttcttccccctaccccacacagttcaaatataaactttatctcatgccctctaaatcacaacatacatcaaattcgtgaaatatgagttgattactttttccacattgctatagatgttggattgctgacagaactatctcttcaacctgagcattctcatcaagtatactaagtctaaatcagtgaaatatgcctgttcacaatctgagtacaaagacaccaaaacatgagcttttatcatctgaattactaattttccagggttgaatattaaaaacacatatttacttgggcacatttatgaagagtagaagtagctgaattctttaggctgcaataattaagtgggtttacactggtcaggattgaattactaaatttaaacaactgaactgttccaggaaagacaagaaacactgaaacatcctaacagcaaaacagctttttgcactgagcgtgaccattcagtctgattaggctgatgggaatggtgcaaagactactcagtaatccatttgaggatttattctgaaaaaagtttactttcctagagcaggcatggggaacctttgatcagaaacactgccaaagatggctaatgggcattgtgtcaaaaaagtgaatctgttcttttcatcagacattctgaggacagcataattctcaagtgtcttggttgtctaaaccaagcgaaagcaccagcgtaaccaggtaggagggctgtgtcaagaagacggacctaaagggcttctcccctatcctgacaactgtgtccacaggcaaaggtgacagtatgccctgcccggactgcatcatgagtagcaatctgattctgctcgcttcccaacagagaaaggcaagtggcttcatacaccaaggcccagaggaagaggcacagaaagctataaaagtgatgctggggccgggcacagcagctcacgcctgtaatcccggcactttgggaggtagaggcgggcagaacacgaggtcaagaaatcaagaccatcctggccaacatagtgaaacctcgtctctactaaaaatacaaaaatagctgggcgtggtggcacgcgcctgtagtctcagctactcaggaggctgaggcaggagaatcgcttgaacccaggaggctgaggttgcagtaagccgagatcacgccactgcactccagcctggggatagagcaagactctgtctcaaaaacatacaaaaaaaacaaaacaaaacaaaaaaaacagtgatgttggtaggattcacctctaggcaatctggaagccacacagtaacaacttcaagttgccagctgggtttggtcaaagaaatgtgtaaagccaggatccactatccttagctgattctgttagatcaaaatgcctaatacaaacaatttcctcatgtctaaaatactgtttccgaaagttatttcttttgttttacaaatagagagcagtaatcattttcctatgaatactagaatgattatataatcctcattcaaacctcacaccaagtgttttcaacagccagaacagagcaatttttaaactacgaaaaatgaagtgcaaaccttacaatttcatagcaatgttccccacgtttcactcatgaacagctatccaattgcatgcaccttcctgcagaacttcttccaagtccagtccttccactggaggggctttcttcctatttctccaataggtctaaaatgtcaggttacagtcagatttggcaatgtgtattacttcaaatgattgagctggaggaaactacattcctttggaatgatgacagaatctatcagaaacttcacacatccactcagctctcctggatccctgtccacaccatgaagcctgaagttgttatgatggcctttatgaacctgaaagaagccgctggcttccaccacaccacagtgtcacccaagaaatccaatccttgtaagaaaggatagggcttatcttctcatgacttagaatttttcagaaatgagaatattcacaaaagagggaaaggcaattcccttacctatgcgctaaggaagccaaagtcagtgtgtgcaagagctagctctcaaaggcaatgaaaggagagtaaagaatagttttagttatcccctatccacttctcattctgactccccactttgctttcttttgcaaaaaggatgagctagttttccatttttataaaaactggcgatagtatgaataaacccagcatctataaagtagttgaataaaatctcaggccaaataaaggcctccataaggaagaactgacattaggactccaattactgcctgaagttctgctgtcaaaatccagctgcatgatgatgccactgtactccagcctgtatgacagagcaagactgcctaggaaaaaaaaaaaattccagcggcaccaagtaccaccttgatgacttctgtattcaccactaaaaactgaaatagaacatactatatacagcttcaagtttgtcactttttaataaaacttttcccacaaatgattataattacttgccctttgaagctattggatagatctgaaagtgaggtagggtggggatggtcattagatcagtaatagttatctgttcaggctcgataaaaagtaaaaactcggccaggcgtggtggctcacgcctgtaatcccagcactttgggaggccaaggcaggtggatgacctgaggtcaggagttcaagaccagcctggccaacatggtggaaccctgtctctactaaaaatataaaaattagttgggtgtcatggcagatgcttgtaatcccagctacttaggaggctgaggcaggagaatcacttgaacccaggaggcggaggttgcagtgagccaagatcgtgccattgcactccagcctgcgcagtaagagcgaaactctgtctcaaaaaaaaaaaaataataataaagtaaaaagtcatttaccatcatcattgcccaaagtctcctggggcttctgcaaaatagattcagttgtgattccggttctatttctagagtactaagcagagctgatgcacagaactcaatgtgagatagattaaacccagattttgtgggatgggggaagatattgttcttttgcttaaaccccacagagtttcaacatggatattaatgatatctgtccttgaaattcaccattaatttctatcaacttcacagcactcagaggtccagagtctggctctatgctaatgcagattctgca

SEQ ID NO: 92 - DNA, 201 bp, Homo sapiens
tgttctgcctatgcttaggtaagacattaggaagaacttccctgagtactgtgatgacttaatagtaggctctgatgcttgggaaagtcattagtacaaasgacatccagatgagtggactgatgttacgggaaaatcatggaggggctgcagtggggagacctggaggtctggaaccatagtggatagatctcctttctc

SEQ ID NO: 93 - DNA, 201 bp, Homo sapiens
ctataatattcaacaaccctctcgatggtgtttccctgcctctgtacagcatgaactatcaggttgttcaggaactgtgaaaatgtagttttacaatgctsaaggaatcattagctttcaattagctgagatagcatttctacttctgagaaagaacagtttaccaaacagtgtcccccagattaacctcaggttatgaac

SEQ ID NO: 94 - DNA, 201 bp, Homo sapiens
aagctactccatcatcaacacgtgttacacttttgcttggatccaagtcagatgtctcttggtttacatcaattgtttgtgcattcagtgttactgggacycctcctaccaactggtcaagcgaatctttaacctgcacctgtttgtcaaaacaatccaaatctatttcaacagctcatcacttattttaaagcacaattc

SEQ ID NO: 95 - DNA, 201 bp, Homo sapiens
ggacagcaacaatgttctcaaacacacgcagcttcccctccagctcagccagaagcttctccttcatgaagtgctgcagggccagctcctcctggctctcrgagcagggtgcccggtagcaatcgacctccaggtcccccgccacttccacggctgcctgcagctgcaggtctgacaggttctgctccagggccatgggcc

SEQ ID NO: 96 - DNA, 201 bp, Homo sapiens
gaaacgcagaagccagaggcagttgggaagtgctggactttgcagatgtgggactgggatccagtggtcaggcatgcccaaggtcagcggctcaaaaccakgaaagatggggttagaacccagcattcttctcgagtagggtgtcagacaggaatgggctcttgggggtcatctagcttagtgtttgtcagctggccatcc

SEQ ID NO: 97 - DNA, 201 bp, Homo sapiens
caaggtcagcggctcaaaaccatgaaagatggggttagaacccagcattcttctcgagtagggtgtcagacaggaatgggctcttgggggtcatctagctyagtgtttgtcagctggccatccaagtcatacactgccgggccccaccctcagagtttctcactcagtgaccctggggtgagaactgagagttggcacttc

SEQ ID NO: 98 - DNA, 201 bp, Homo sapiens
gtcattagtacaaaggacatccagatgagtggactgatgttacgggaaaatcatggaggggctgcagtggggagacctggaggtctggaaccatagtggayagatctcctttctcacactcagatgcttaccttgaaggagcagccgacacctgcaaaggggcacccaattccagcctcagccacctcggggtgagcctgg

SEQ ID NO: 99 - DNA, 201 bp, Homo sapiens
ggcatccctgtttaggacatagctgacactcaatatatgtttaagtagtgaagagatagatttataaaataaagagtggaacagatgatttcaatggtctyagccaattgtaaaatactacagaaagttcttcatttacctctactggcctcccaaggaaattcttgtctgtcattttataattatgtaaggcacctttat

SEQ ID NO: 100 - DNA, 201 bp, Homo sapiens
ctgacactcaatatatgtttaagtagtgaagagatagatttataaaataaagagtggaacagatgatttcaatggtctcagccaattgtaaaatactacasaaagttcttcatttacctctactggcctcccaaggaaattcttgtctgtcattttataattatgtaaggcacctttatgcttgtaagaaacatcgatgtc

SEQ ID NO: 101 - DNA, 201 bp, Homo sapiens
agaaccatctagatgaggagtttgctaaccttttttatgtaaaggggtggatagtaaatattttgggctatgaagtctttgttgcaagtactcaattttayataattttcatgtgtcccaaaatatctttttttgtttttttgagacagggtctcattctgctacccaggctggagtgtagtggcacgatcatggttcact

SEQ ID NO: 102 - DNA, 201 bp, Homo sapiens
acctgtagggaagactgttcagccaggaacaccagaacccggcttggggatgggatgggaatggcgggatgtggagattgatctgccccagatgtgttttsctgaccacgcctcactcaggtgtgcgtctgcatctgaatgtgctgccccctgcctggccttccttttccttatccaccaggaatccagctcatatggccc

SEQ ID NO: 103 - DNA, 201 bp, Homo sapiens
actgaatgttatagcgatccctgtggctaccctggggctctcttcaatgcaccaggatccaccagggcaggagatggcttgggccacatgactttgcacaytgctgttccctttggctatctcctttccaccctttaagcttccacccttccatgaccttccttcaaaacaggacctgggcccttactgtgatcctgggca

SEQ ID NO: 104 - DNA, 201 bp, Homo sapiens
ttggcttgtggtcccttcctccatcttcaaagccagcagtggagcatctccccttctctctgaccctcatctccctcttctgaggacacttgggcctcctrgataatccaaggtcacctccccatctcagaatccttcatttaatcgtgtctgcagagtctgttttgccattgttatgggctcagcaacccccacccaaat

SEQ ID NO: 105 - DNA, 201 bp, Homo sapiens
gggtgcctataattctaccatgaattatagtgccttcacttggcttaaggcagcaagtttcaaactgtgctctgcagggccctaggagtccccagaacctyttaggggctcggataggagaaagaaatggggcaattaacaggtcggggctccaggatccccctccatcagaatgcttttactttcatctgattgaaaaag

SEQ ID NO: 106 - DNA, 201 bp, Homo sapiens
agagccaaacagtgaggctcagggagttactccacggagcagcatatcatattaactcttaccacgttgcagagtgtaaagttccaagaacatgcatttgktccttactcttactctctgagggcctgccgatggagaggttgctgagaagcagatgggagagtgctcaaaaccagctctgggtgggacaggaaattcccc

SEQ ID NO: 107 - DNA, 201 bp, Homo sapiens
ccagggttctaaattgtagctcctgaaaatgtctctctggcctatcacacttccaaatgtgtctcttattcctagaagcaccgtttgacagagctcaggasgtgagctgataatggtctctccccacctaaaggcaaacagaggcagacagaaccatctagatgaggagtttgctaaccttttttatgtaaaggggtggat

SEQ ID NO: 108 - DNA, 201 bp, Homo sapiens
caccatccactctcctgacagctccagaagcctcaactatcagcagggtggtgatcatgtacgtccacaatcccagagccacagttcctaaatcgcaaaastgccgagtatcccacattttttggtagtttgcagtgagcttcctgggctgccaaacctgccgtgactgcactgaccggaagctattatagcccttacttg

SEQ ID NO: 109 - DNA, 201 bp, Homo sapiens
tcttgtctcatctatcaaatggagaagacaatccctacacatctttccatcctgcttggctgctacagaggttttgcaaactttcacagtggtttcagatyatgggttttgaggtcagacagagctgagttgaaatcctgggtccactgcttactaactgtgggccctgggacaaagtccttaacttccctgaaactcaga

SEQ ID NO: 110 - DNA, 201 bp, Homo sapiens
tcctgcagccagccctacctgttccctccttcccctggtttgggataaaacaggcacccaagacttctctccccatctgtgggtcccttctctcccctccrgcctcaataccaccctctctacctgctcattcccacggacatcaaaacgtgcgcaacctgctctaataagaaaagggaaaaatagtactacttttgggta

SEQ ID NO: 111 - DNA, 201 bp, Homo sapiens
gcacccaagacttctctccccatctgtgggtcccttctctcccctccggcctcaataccaccctctctacctgctcattcccacggacatcaaaacgtgcscaacctgctctaataagaaaagggaaaaatagtactacttttgggtaccgtcttacgtaattttacagacatcatctcatctaattttcactctgtgaag

SEQ ID NO: 112 - DNA, 201 bp, Homo sapiens
aatctccatcttggttcttattacacttataataactagcatttttaaaaacgtgcctgtttacaggtttttttctttctaccacagaattatgaatacaygaaattgtaggaatatatgaaaatgtgtataggaatatatgaaattagatgaattaaaaccatgaaagtaaagctgtatctgatttcattgttgtttccc

SEQ ID NO: 113 - DNA, 201 bp, Homo sapiens
ccttatcttccacttgtctcatataagcaaactgcttaagggtctctgtctgcacctcccttgagtcccactgctgggtgtttgcttacattacttctccyctcagaaataacttcatttcagtgtatccaaaccttagtcattcttccagacccagcttagaggccatcttctccatggagccttctccactgcatgcag

SEQ ID NO: 114 - DNA, 201 bp, Homo sapiens
cttccaaagcaactaaaagcttgggcttacctcagataaaggcacttaaccattacctgaaagatcagctgtgcttcaggctttaaacccttaattgctcrgtattctcatgttcacaggttgagggactcagtattaacgtgcctttgttgcaagttcttgtaaacaaagacagtaaaattatggttctgatgttctatt

SEQ ID NO: 115 - DNA, 201 bp, Homo sapiens
gccagagtgagcagaaaagctgacaggagcacctgctcttcggcttgctgttgaaatcctgaaggctgggtcaggggccaatgagcaagtgggagtgaggrcacaaagtgaggcttggatctggtactgaaggctcctttgcagaggctgtttctgggttgcagctactctgcttaggacacgggatctggaacattaagt

SEQ ID NO: 116 - DNA, 201 bp, Homo sapiens
tccataaacctccaggaacacagaggcctcttcacgtagttctgctgctgccaggcccattcagcagcatgctggccctgtattcctttgcttcctgctcsgccactagagcaatggcataatttttaaaaagtgaaataacatgaataacatttgctaggaacattacaaaaaaggtgaagttaaaaaaaagaatcccta

SEQ ID NO: 117 - DNA, 201 bp, Homo sapiens
caaaagttaacaggatgacccatcccagacctatagaatgagaacctgcactttcacaagctcttaaacaacacttctgaaactttaacatgcctataatwttcctggattttttttttttttttttttgagatggagtctcactctgtcacccaggctggagtgcagaggcgcaatctcggctcactgcaagcttcacct

SEQ ID NO: 118 - DNA, 201 bp, Homo sapiens
ttttgtttggcttgaggggacctcatctcttgttttttctcctaattcaatggatcctctatctcttttctctaataacttcatcttggaatgctcaaaakgtctatccttggtcttctttttttccactcctctgtctgtattcacatccttagtgatcttaactagtctaatggttttagtatgctgatgattctcaga

SEQ ID NO: 119 - DNA, 201 bp, Homo sapiens
aaaatataaaattatttggtatttggcaactgttaactttgtggaaaagtacaaaatgtgaaagacttggaaaacttcaaagatagtaattttgggattcycaaagaactcacaagtagccagttcccctacctggaatgcattcctccccatgttggcctcttgaatttcatttatcttgaaagtctccttcaattctca

SEQ ID NO: 120 - DNA, 201 bp, Homo sapiens
tcacaaaaaactataaaagtactatagaaaatatagaaaaaacagttctttagaaaaacattttattttaggttcggggcacatgtgcaggtctgttgtayaggtaaatggcgtgtcgcagaggtttggtgtgcagattctttcatcattcaggtaataagcatagtacctaataggtcattttttgatctttacccttct

SEQ ID NO: 121 - DNA, 201 bp, Homo sapiens
ggaatattatcccattaatgaatcttgagatatttctttgtaagaagaattatatcactgcttctcatgaatctcaccagcattgacctatgacccccatstcttccatttcagttcttttaaattttacttattcactttgttcttgttgttctttttattttttgtttttttaaattattcttttttccttttcctact

SEQ ID NO: 122 - DNA, 201 bp, Homo sapiens
tcagggacggaaagaagcaaaaatgaaaagaacagagagcaatacagagacgagagattgaacagagttatgcacaaagacaacacagagacagagggaarcaaatgagacacactggaggcaaaaacatagtgagagaaaggagtctattttcaaggaatgatatctccatcttaaggctttttaagaatttgccaccaa

SEQ ID NO: 123 - DNA, 201 bp, Homo sapiens
gaatcttgggctcacaattcccatctgcatccctccttggccatctatccttgactgaggtgtgtccactccgcacaactttcccttccagataacatccwgcctgagggaagggatacaggagggtctcagtgctattataatagcaatttgaccccactgttagcctatttaggtctgaagcatttaccaaatgctttc

SEQ ID NO: 124 - DNA, 201 bp, Homo sapiens
ttagctgtttttctaaaaatataactttcatcaaagctccttacattcactaccaccacccaaataggtccttgctcctcggtcatcaatgcttataattwgcaagtgtactttaagttcctgaagagcagcagcttcaggagcctactttgaaagcgccacctgctggtattaacttaatagcttcccaaagaaagctgg

SEQ ID NO: 125 - DNA, 201 bp, Homo sapiens
aaactaaatagatactaacaaagaattacatcttgctaatcaaatcactatttaaatgcatatatcacttaaacctgcttaccagtgtttgaaatgccaaygccttgaatttcccaggtggttagagaatcaggtagggcaaactgcaactgttttctggaagttaaaatgttgatattcaaatacagtggaatattgatt

SEQ ID NO: 126 - DNA, 201 bp, Homo sapiens
accaagaggtttatatttgttattataaggacttttgtgattattattcattgggcttcattaacaattctatgacacagaaaacagctttacagacaagygagctgcggcttagggacattagcagagcaccagaccacacagtgagacagtggcctcacagcctcgaggctctcctcggtgtggatggctttcccctgt

SEQ ID NO: 127 - DNA, 201 bp, Homo sapiens
tcccagcaaacggtctgaggtgatgagcaatgctgtggaaggagagatattcgtctaacagtttgtcattcaccaagaggtttatatttgttattataagracttttgtgattattattcattgggcttcattaacaattctatgacacagaaaacagctttacagacaagcgagctgcggcttagggacattagcagagc

SEQ ID NO: 128 - DNA, 201 bp, Homo sapiens
cgagctctgctcccaagattttctgtttcagtaggtctggggtggggtctgggaatttgcattcctgacaaactcccaggcggccagggaccacactttgyatagcattgttctaaggctgacagtcctgaggaccaaaagaggaaggcaaatgggaaaattcgaggcactggaggaggttgttttttaagatagtggtct

SEQ ID NO: 129 - DNA, 201 bp, Homo sapiens
gtttattcccaggtatcacacttcaaggaacacagataaacagaagcgcatttaccccaaatgcacagagactggggaaagactgctcagtgtctttccawggaggcaggactgactccagggataggaggctaagttgccttttgtgacctcaagggagacagacagacttcagctcagtacaaagaaagaggagaatgt

SEQ ID NO: 130 - DNA, 201 bp, Homo sapiens
aatgtgtattaattttgttaagaggaaagaataaaacaagctaaaaacaacagtcctagagcattcaagcaggtaagggccttttgcaagtgaggcatagwggctcacagagttgagggtctgcttgtgtctcacagccgatccaccaagagccaaacagtgaggctcagggagttactccacggagcagcatatcatatt

SEQ ID NO: 131 - DNA, 201 bp, Homo sapiens
gcacaatgttacatatacatagattaaagaggtacatacatacaaaacaacattacctttctattcaaaagtatacagcaaacacatttgagtgggtacayttggaggaaggggaatgggaatggggtccgggatgaaggaaaaaataaaacgagaggggcctgcctaaaccaatgaggatggtgtgtcaggaaatgaggg

SEQ ID NO: 132 - DNA, 201 bp, Homo sapiens
acatggcacatgactgtatcttcataaaggcttgtatccagaatatatagagaactcttacaacctaataagagacaaatgacctaataaaaaatgggcayagccaggctcagtggctcaacacctgtaagctcaacactttgggaggctgaggcaagaggattacttgaggccaggagttcaagacagcctgggcaacat

SEQ ID NO: 133 - DNA, 201 bp, Homo sapiens
ggtcacatggccaattcattgccaaaccaggactaggactcaggcttccatgctccccaccttacccccatcaccttcacacccataccttgttccggaarggccacggcagcagcgcatcatactcccctctcatgatcacgatgaagagcgacagatgggttctctttccagtgccatctccattcaggtacagccgca

SEQ ID NO: 134 - DNA, 201 bp, Homo sapiens
tactttattataaaaatatctgtcagacaatagcataaaactgttttactaacatggttacaataacaggattcagataaaatgtaacaatttgaaattaygtaaagcacttgaggcactttaaagtgtctttcatcctaagcaaaaagaacaaagctggaggcatcatgctacctgacttcaaactatactacaaggcta

SEQ ID NO: 135 - DNA, 201 bp, Homo sapiens
tgtattacagaggtatagatctatgattctatactcattgcagatgttcaataaccatttatggaacattgaatgatttagtgtagtgtgaggacagggtwatgaaatgagattcttgtcctgaaaaatgaattaaagtattatttaaataaataaaatacttactatgaaagttaagacagtttctcttttggctggctt

SEQ ID NO: 136 - DNA, 201 bp, Homo sapiens
tctttaaaatatctgttgaatgcatgtcgtgaacgccgtgctcatgggcaagccccagatgaagcctgtgcaagtgcttcttgctttaactcccttgtagyaatcagaggaacatcctctgcctaggattcccaagctccctgaacctcacgcgacagctggagcccaggctgcgtccgctttgaggttcatccgagcctg

SEQ ID NO: 137 - DNA, 201 bp, Homo sapiens
tcagggagttactccacggagcagcatatcatattaactcttaccacgttgcagagtgtaaagttccaagaacatgcatttggtccttactcttactctcygagggcctgccgatggagaggttgctgagaagcagatgggagagtgctcaaaaccagctctgggtgggacaggaaattcccctgaactctctgaatgaga

SEQ ID NO: 138 - DNA, 201 bp, Homo sapiens
gctctgggtgggacaggaaattcccctgaactctctgaatgagagggaccagctcagagaaaggagaaggaggtgtggacactcgcctgcctctggtccarcggtagggggatagctgccctgccagcactgctatcacggtctggacatcacagatcctggaaaggccttgcagagctgacttaatatcctcattttaca

SEQ ID NO: 139 - DNA, 201 bp, Homo sapiens
aggtgcagcaaaccaacatggcacatgtatacctatgtaacaaacctgcacgttgtgtacatgtaccctagaacttaaagtataataataataaataaagygtccttcatgcactattacatttcatcctcataaagccacattaataaagctatgtgctagatgaaaaaaattgatcttggggagatcacaagacttaga

SEQ ID NO: 140 - DNA, 201 bp, Homo sapiens
gtgaaaggcctcttagttttgtccagtgggggagggtgacaaactgaacacattgctggattcctacggcggcagaaggagtgaacgatgggatacagtgyggtgcaatgaacgtggaatggtgaaaggtctttagagactgggggagtggcccagcacagtggctcacacttgtaatcccagcactttgggaggccaaaa

SEQ ID NO: 141 - DNA, 201 bp, Homo sapiens
aatgatgctggtactatcattattcgtactttgcaagtggtaaaaggctaacttggctaaggttatacggtttgtaagtaaatgggggaggcctttatatsagttctcagttgttatgtgtacagttgaggtcaagtttatatgttattcacaaccatagactgttctcttatttttacttttcatgtgatttatacaata

SEQ ID NO: 142 - DNA, 201 bp, Homo sapiens
gacctcaaatgatccacccacctcggcctcccaaagtgctaggattacaggcatgagccactgtgcctggccagaagtggatactactgattttagacaaytcactttctgaaaaatagtgttttaagttacatacacactttaacttctaaagcaaaagataacatataaaataaaaaatcattttgcctaccataaata

SEQ ID NO: 143 - DNA, 201 bp, Homo sapiens
ttgtacatttaaaaataactaaaagagtataattggattgtttataaaacaaaggagaaatacctcaggggatagataccccattttccatgatatgattrttacttattgcattcctgtatcaaagtatctcgtgtaccccgtaaatactatttacccacataaatttaaaaattaaaaaaaattaagagaaaaaaaagc

SEQ ID NO: 144 - DNA, 201 bp, Homo sapiens
cctcttaagactgttcccaagaccatgatcactcatattggctcaaaatattccactctgaaatatttcacagattttttttcctctgttagcaagtcctygggcaaggtctagtgctgtcctggtcttggaggcagtggacttagggtgcaacacagtttaacactagctgtggcagccacaggagtatgtatgtcactc

SEQ ID NO: 145 - DNA, 201 bp, Homo sapiens
gtgatggagccaagattcaaggcccagcagcctcgctccagagactgcatggaaccacagtgcaaggatgcatgggaatgtgctttgcacaaaataagtcrgtacatgtttactgaagtgaatttcatagctgaaaacagagagtgaagagccaggaaatccagtctgtcattaattggccatatgacccttagcaagaat

SEQ ID NO: 146 - DNA, 201 bp, Homo sapiens
gtgcttggaggagagagagcaaagtgagtgtgggactttgcactggaagtcagtgctgccccgtcatggtggaacataacacaggacagaattctgcaggygcctagaattctgacagtgcatttaggcaggccttgggacagaggagaattctgtgctccagagggagaaacccaggtcatggctagcttcaccactggc

SEQ ID NO: 147 - DNA, 201 bp, Homo sapiens
ggcctctaagagagaatttctgcaatctatgggcaggggcctctaagagagaatttctgcaatctacgggaggttgcccagatgtagcctctgtggggccwttcaattctacgggaaaaggattcaaagagttaagtgtttgaattaaaaattgatggactcggccgggcgcgatggctcacgcctgtaatcccagcactt

SEQ ID NO: 148 - DNA, 201 bp, Homo sapiens
aaccacaggctgcacagcaggaaagagaatccgtgtgcttggaggagagagagcaaagtgagtgtgggactttgcactggaagtcagtgctgccccgtcayggtggaacataacacaggacagaattctgcaggcgcctagaattctgacagtgcatttaggcaggccttgggacagaggagaattctgtgctccagaggg

SEQ ID NO: 149 - DNA, 201 bp, Homo sapiens
agcagtgattgaattccagctgtggcatctgctggctgagtgaccgtggtaaagtcactaagtctttctgaggctaaaataacttactgtgaaaataatcrccttctttaccaggctctggtaaagattaaataagaacatatatatgaaaaggtctagcactcttagtactcaatacatgttaagatttattaatctcac

SEQ ID NO: 150 - DNA, 201 bp, Homo sapiens
gataagtgtcatgaagaaaataaacaagatgctgagatagggagtaaaacaaagcaagagattacattacatcatgcatccaggaatagcctttttgtagyagcttctactctgggtcataacaatgaaaagaagccaggcttatgaagagccaggtgaagcccattccaagtagaggggatgacatgtgcaaaggcacgg

SEQ ID NO: 151 - DNA, 201 bp, Homo sapiens
aataaataagtgaataagagtctttaagaaaggacactcttccttagtagaccttaatttttaaatttgggtctccatttatttgcttttctacaatgtaygggttaaaatctctgactttagagttgcaagagatctttgagtcatctattctctttcctcacttgatcaataatctcaacagaccactctactggaaca

SEQ ID NO: 152 - DNA, 201 bp, Homo sapiens
aggagcagccgacacctgcaaaggggcacccaattccagcctcagccacctcggggtgagcctggaaataataatcacatcactgaatgttatagcgatcyctgtggctaccctggggctctcttcaatgcaccaggatccaccagggcaggagatggcttgggccacatgactttgcacactgctgttccctttggctat

SEQ ID NO: 153 - DNA, 201 bp, Homo sapiens
ataatttgtggcttacctggagctggttgccacatttttcttcaatatttaaccagactgaatcagacactaattctgctgtctgttctcctgtgacgatrtaatagaccagaagtcgggatgaaggaaccatgttctgtgttactggaatgtttatactttgataagatgcatctgaaaatttctccctcgtgccaaagt

SEQ ID NO: 154 - DNA, 201 bp, Homo sapiens
tttaactgattatacaatctttgatgtacaaaatatttatagatcaaatatttgaagacaaatacccatgtcttcaaattaaatatgaaggatgaagatcwgttaaatgttatagaagggaaatatggttcatttcagccatttcccttcttctttttccaatcttccccatctctcctcattatcttgaagagactcaac

SEQ ID NO: 155 - DNA, 201 bp, Homo sapiens
gaaaatgaagcattcacaacacgatttaaaagaaaacacatacggcttttaagtcttcttcatttgcactgattccagtaggcaaggagatgtccatcacygcatgagaggatccagatgatgattcttccctgctgggcttgtagctaaaataaaaaagaggttagaaaatataataaataagtgaataagagtctttaa

SEQ ID NO: 156 - DNA, 201 bp, Homo sapiens
agctttggagtagctaagtcaggagtaaactcatatctgacttcaaagacaaatctcttaacacttcacaaggaatctcctctaataacacaaggcaaggyattggcagagtaaacaaagaatgtcaagaacatgagaaaattttaagacaactagataacatcaagctgcttcccttgggttctgtgatcattagtgcta

SEQ ID NO: 157 - DNA, 201 bp, Homo sapiens
agattggcccacattttacattgggtctctcttgggattttggcttttggaagtctctcttcttttagcaggctagaaaggcatatgagtgcagttatacrgccaggctgcctctccacttatctatacatctgtatatataaagatgctttagttacatctttgaaaaaaggcaatggcaataaatagaaacaacggact

SEQ ID NO: 158 - DNA, 201 bp, Homo sapiens
aagtcagtcaaggagtaggtgtgataaggtcttctgctatctaacttctgtatttctttgattggtttaggactggataaaggagaaaatgaggcaatcgyttctgggaataagtcccttgaatatgagaaacaaaaatagatacaccttttttcctttaacatctacctctcactgccatatatatatatatatacacac

SEQ ID NO: 159 - DNA, 201 bp, Homo sapiens
ccatccccaccccaatcctggtccatggaaacattgtcttccacaaaacctgtccctagtgccaaaatggttggggactgctggtctatgtgatggtagcygtcaagcaaaaatacatagtgtttagaagcccctaaaagaatattctggaaccaccctttataaagattttggttcttattgacttatcagtagcataat

SEQ ID NO: 160 - DNA, 201 bp, Homo sapiens
gttcttgttgttctttttattttttgtttttttaaattattcttttttccttttcctactctatttctcatttccatttcttttctctgtaatatataatygagtatgattttatgtatttgagattttatgtttttcaatcttaagttaacttcacttttttcatttgtagaataggagatattgtctactctgtccacc

SEQ ID NO: 161 - DNA, 201 bp, Homo sapiens
atatagaggagaaaggcactggaggcttcggtgccagcagtttaaagactgactggagagagggcggaggtggagcaagatggctgaatagaacccccccmgagatagttctccacacaggaacaccaaatagaacaactatccacgcaagacagcaccttcataaaagccataaaatcaggtgagtgatcacagtgccta

SEQ ID NO: 162 - DNA, 201 bp, Homo sapiens
agtgttttaacccaaaagggcatagtgatcgactaattcaagtggcccaacaagcttggagggcacccaccaccccacctggcagaattattccaggcttytgccaacattgtgacattttaagagtctggtaaaagcaggaagtttttagtaacaatggaattaatttatcagcaattaaatcctttaaagcatctgaca

SEQ ID NO: 163 - DNA, 201 bp, Homo sapiens
ataatggaagtgagtctatacatgcttttgagtgatttttaaaaattattttatttaaaaacttacaaatataaactggattactaagtgtatatcacaaragtatctaatttgaatagcgagaactacatacgctattacataggaaaaaaaagtgttttaacccaaaagggcatagtgatcgactaattcaagtggccc

SEQ ID NO: 164 - DNA, 201 bp, Homo sapiens
gaagctggaggtttagtttacatttagaaagttaaggtgatagcagcactttctcttagctactgcagccaaggaagacttttaatcatgttgaccagaamatgtaaatggggtcaatattttttgctcaatgaagaaaaaagcagtgattgaattccagctgtggcatctgctggctgagtgaccgtggtaaagtcacta

SEQ ID NO: 165 - DNA, 201 bp, Homo sapiens
ttgcttacacttccctttgacaactgttacaaatttaaaggtaattgtgatcatgctcctccccagctggtaggtgcccaagggtaggaatggcatttagkgggaaagaagctgcctgggaaagggcgaccttactggaaagacattagggaatgaggaaagatgtttgagcgggaacagagagcagggactggccacaga

SEQ ID NO: 166 - DNA, 201 bp, Homo sapiens
agcatattccacccgcctttctggaacattttgtccccaatttgtaaaaaccaaaggatagactattcaagattgcatttctccttgctttcttttgtatrttgataatctggaattaggcctcctgacaatgaagtcaaatgaatgaatttttgataacagcttttttctgtacggcagaattgtggataattagaactg

SEQ ID NO: 167 - DNA, 201 bp, Homo sapiens
ctttgacacttgacagttttattatgatgtagtcaggtgtggttctctttgagtttatcatacttggagttcattgagttttcttgaatgtgtggattaaygtgtctcatcacatttgaaaattttgaccattagttcttcaaatatttttttctgtcctttcctctctctctcgtctccttctggaactctcttcatgca

SEQ ID NO: 168 - DNA, 201 bp, Homo sapiens
tatattatttaattattaacacaacagtaaaataaactttgccttattttttcttataaaattgagcgacttgagggcaggcatttttgtcttatttagcyttacatcccagtgtctagcatagaattttgcattttaaaaatgcatttaatttacatcttgaattaataagattgtagaggataaatgattgatgatgca

SEQ ID NO: 169 - DNA, 201 bp, Homo sapiens
gattgtagaggataaatgattgatgatgcaaaccaaatgaatacgaaaaagtgagcaaaaatgacatgaactcatatcatctgtggtataatgtaaagaaygctgaataagggaaagggaaccagcgccctaatctcagttccagcaatcattagccctaaactatggacaaataacttcatgaatatttccttgcaagaa

SEQ ID NO: 170 - DNA, 201 bp, Homo sapiens
attgtaattttaaaatgacctaagcttttgtgataggttgcttgcaaaactaacccccaattctctacctccccatgtatcaacgacctttgcacagttcmttgtgtccacaaagtgtgggaggggtctatttcctctgggctgaccttgtaacttgctttggacaaaagaatgtgtggaagtgatggtgtgccagcacca

SEQ ID NO: 171 - DNA, 201 bp, Homo sapiens
tttaaggagcttatccaaatggtgacaacacaatagctacccattattagcttccaacatttatcagttattgtgataattaacttgctaaattatctctyatcttgacaaccatgcagaagggtgttattaccctctggttaccaatgagtaaactaaggctcagaaaaatgtagtgcttcagggaacacatctaataat

SEQ ID NO: 172 - DNA, 201 bp, Homo sapiens
agagactgtggcaggcaggcatacacacgcacatgctcgcaggatggctggcttacccaagatttcaaaagaagttggaaatctggatttttatgtgaaaygacttgatttttagaacaccctataagccaaaaaataaacccaaaccaaatgagcatccctatgaactgtgtctgtgggccactatttgtgacctctggt

SEQ ID NO: 173 - DNA, 201 bp, Homo sapiens
tctgaaccgctgcacaaaccaccacccagatgcctgcactctgaattaaaattgccagttactttgcatccttctctaaactaagctttatgaatttagasactgtgtttcatttgctggtgcatcccatcacctggcactatgcccagcagagcacagaaggtgctcaatacgtactggtgggattgtacccacaggctc

SEQ ID NO: 174 - DNA, 201 bp, Homo sapiens
atagaatgactaaatgataaacctatcaaaaatagtaactacaattattttttaagagacagaccatgtaaaaagatacaaatagataaaacaaaaagtcmaaatgcaggaaaaagtgtagatgtttgtttggctttctctgcttgtttttaaaaacttttctttctgataatagttaagttgttataagtctaaaataat

SEQ ID NO: 175 - DNA, 201 bp, Homo sapiens
aatattctatgaattatattttttagccagatgttttataaatgtatagtatgggcatttttcagcttggtaaaactctcaaatggttaaacaaacttgayagttctcgtaaagcttccccataaacttaattttgtgtttgggttagcaaataattgaaatgaggttttgactttctttggactacacatgggggtccaa

SEQ ID NO: 176 - DNA, 201 bp, Homo sapiens
ccagatttttgcacaagccatactgaactacttcatgtttccatactcatgttttgttccagccacactgaattacttaacattcagcacattgccaagcycttttcccccgcttccggggtttgcacaagttgttccctttgccaagcaaattcttccccacctccctactccttgcctaaactcttcttttgggcgtag

SEQ ID NO: 177 - DNA, 201 bp, Homo sapiens
ggtgcccagagccaggctggggtgttctctgtgtctgatgtcatagaacatcaacatcagacaaaatggatccatactaaaaacgactactctataatcawgtttgagcaggatataaaaacaagaacattgtccaaaccacaaaaatgaccacacacacccttttcctggctaaagtgagtaagtgctgctacttttcct

SEQ ID NO: 178 - DNA, 201 bp, Homo sapiens
gtttccttgttcttttacaagtgattttatacattaaattatagtattttggtacagatgcaccaaagctatttaagccatttccctttctgtagacattyaggttgttctcagtctttgctctaattgatttaattattttaaagattttttttttgatattaatcggaacttgcccctccacaactaggtgccttttcc

SEQ ID NO: 179 - DNA, 201 bp, Homo sapiens
agataaaagattgttcctatcctgtggccttgatgttcacacctaggatgagtaaggcaagactgctctggaaaattgtttgcaataatgtcagcagaagmagcatctgtggtgaaaaaaaaaaaaaaaagaaagagaagccaaggacacagtggcttttgaggcttgatataattgcatgaggctaaaacccttgaaact

SEQ ID NO: 180 - DNA, 201 bp, Homo sapiens
gcactgtcctcccaaccttgtgggcagttgcagatgggacctgccccaggctgctttacagatgggaacctaagtcagatggtggtagtgaggagaggttrgaggatactggcccattgcaagtgtgtgccagtgttattactagcaagggatcttttgtgatttttttttacgtttttgaaaataaaagaataaatagct

SEQ ID NO: 181 - DNA, 201 bp, Homo sapiens
gttcttacaaaatcccagtgatctggcccctctcacttctctgacctcattgtccatcacttgctttcttcgatccagccacgtcagccttctcgctgttycctggacccctgggtctttacacgcaccagcctggaccttcatgtggttgttccttcttgtcaagaaaatctcagcttaaatgccaccttatttagtgat

SEQ ID NO: 182 - DNA, 201 bp, Homo sapiens
ctcatctcttgttttttctcctaattcaatggatcctctatctcttttctctaataacttcatcttggaatgctcaaaatgtctatccttggtcttctttytttccactcctctgtctgtattcacatccttagtgatcttaactagtctaatggttttagtatgctgatgattctcagatttatgtttttcagcccagag

SEQ ID NO: 183 - DNA, 201 bp, Homo sapiens
ttatggagttcttatgattactctttctaggattactgtttcttgcttttccaactcttttctttctgcttcaattatttttaaaagaagacatgctaaartctctgttttttacaagaaaaaaaaccaggtatcacaaaatctttgaatttttttttccttccaaaataactgccaaatctctcaaaacacttagtctat

SEQ ID NO: 184 - DNA, 201 bp, Homo sapiens
gtattgaagacagagaggggccacaagccaaagaacacaggtagcctctagaatctggaataggcaaagaaattctagagcttccagaaggaatacagccytacccagctccttgattttgggacttctcacctctagaattgcaagatagtaaaactgtgttggtttaaaccattacatttgcaataaattgttacctag

SEQ ID NO: 185 - DNA, 201 bp, Homo sapiens
cagtctttcattatttctttccaatttaaagcactcaagacaatttcgtacatgcagcacttttcataaattaggctgtaaattatatttgttatttaaayctgtaaacctcaaatcctttttggaacaaactatttgttttaaaaaaagtaatgcatatttggaaatcatatttgaaggttagtaaaaattttgatgtgt

SEQ ID NO: 186 - DNA, 201 bp, Homo sapiens
ctttaaaagtactattatttttaattggtaaatcatacttatataaaatattaaaattatataaaaatattaaaattacataaaaatattaatgttaatarcgtgaatacaattaacagactgtgggtaaattgtacttaacaaattatacttttcttcttttttgggactgtttatttgtttatacaatggaaagttttc

SEQ ID NO: 187 - DNA, 201 bp, Homo sapiens
agataaaatcatactcatatttctcaatttctttctaatagtaattttcatagcaaacaagtattttcaattatctccaaatattttcacattagtacaaytttattttccaataagaatgtgaaaatggacatgcattgctcaaaaagcagacataacttctgtttagaattttctgtttctgttagaattttcacttac

SEQ ID NO: 188 - DNA, 201 bp, Homo sapiens
agatgaagtgtaacaacacgtaaaaacaacaacaaacaaacaaacaaacaaacaatgatgtttttgataaactaaatgtgaattttgttggctttataaayaccagaatctaatttttatatatgttcatttaaagctttcaaaagcaaatattctatgaattatattttttagccagatgttttataaatgtatagtatg

SEQ ID NO: 189 - DNA, 201 bp, Homo sapiens
tctggagtcagcctggtaccatactccaagcgtacagaattctttggagactgagccagagcgtaggatggcaatgtgaagcagcatgctctgaggaagaygtgaaggcgctggggcttttagcctgaaaagggaagcactcaggtaggacagaatctgaccctccatccctgaagggctgtcatggggactagaaggtgg

SEQ ID NO: 190 - DNA, 201 bp, Homo sapiens
acagcagtggttctttgccttccttggtttgtacatgcattactccaatttctacctctgtctgcatgcgaccgtcctctcccagtgtctgcatcttcacstgaggttttctctgcgtatccctgtgtctacatttccctcttctcataaggacacctgtcattttagattaagagccaccctattccagtgtgacttcat

SEQ ID NO: 191 - DNA, 201 bp, Homo sapiens
cttgagtagagttattactcctagtcaaggagagctgcatcaagggattctccaggagagcagtaagggtatattattttctgatgactgatcaaacagaycctgatgcacataagtaaatgttgtactttatgtcaagtcatctgttgtgtaaagtattcattcatttgtttccaattagtatattgagaatttggaaaa

SEQ ID NO: 192 - DNA, 201 bp, Homo sapiens
cccctcctcacatgctggccagatagcttcccaagccctcttgatcacctctgtaatggaattgtccctgtgggctgtcttctactttcttttgacctggmatctgtctcatgtccatgcaggttctctgggacactatttgttgtttaatgactaatcaagattattctttattaagatgtttcagagactccagaaaga

SEQ ID NO: 193 - DNA, 201 bp, Homo sapiens
caaatgtaatattctagtagtatactgagggtatgcagaccattggtttaaataacaaagaaatcaagtaggctggttcctcttcacaacagcagataccrtagggccatttatgtaacataaccatcacataaataaaagttttgatggagagcagtggtttgctaatttattttagccttagaactcttgatacaaaca

SEQ ID NO: 194 - DNA, 201 bp, Homo sapiens
tagcactatcttttggaagaaaggaggggaatgagagggagaggtatggcaaaagtgaggtagagggaatgacagtgagggaaatcttgttggatagtctkgagcttcttagtatatagacaatgttgttgtcaactgaagggcaaagagagtttggtagcttgagtagagttattactcctagtcaaggagagctgcatc

SEQ ID NO: 195 - DNA, 201 bp, Homo sapiens
cagtaaatgttagccactagtatgatattctttagaattaacttcaatcatcatcttttcattaaatttttggaagtagacaaaattcatatggagtcaartttactgagtaaggttagtgatcaaactgggaaaataaaaacaaagtgtacctgaagcgatggacccgattttcttgtgagacttaagaattagtttgaa

SEQ ID NO: 196 - DNA, 201 bp, Homo sapiens
gttttccttgatttagaagcaaaggcaagttattttataacaggcaggtaaataatgccacattcctagagtatggtgtgttgccagaatctggtattttwtgatgtgatgattttaatgaagaggcaaacattccaatgactcctagagatcgttcaagataaaaccattcctgacaactcattagtaaaaaattaagtt

SEQ ID NO: 197 - DNA, 201 bp, Homo sapiens
tctaaaatgtatctggaatatatgtcctttttccttctctgatgctagacccttgtgctgtcatcatctctcttctggatgactactgtggctgtctgatsgatctgtcacttctactcatgaccctgctccccagagcagccaagatgctctttctgaaatgtcaagtggctgtaatcagtctcccctcctgtagcttcc

SEQ ID NO: 198 - DNA, 201 bp, Homo sapiens
ttttcatctcgtgcagtcatgtgaaaatgttacttcatagtatgactccttactgagctaatgtctgttactgtgctttataggatgcaaatgctaatgakattaagatagcagatcataggagacaaaaatctaatgatgagagcccagagagacataatcatggaagacggtagtaaaagtaaaaaagtaaaaaaatta

SEQ ID NO: 199 - DNA, 201 bp, Homo sapiens
tctttttagtagttaggctacaagtatctgtattgtctacatttaacattttttaatgggtgtatatattattttttagggacttcattgatggaaatgtwgagagtcttatgactgaactagaaatagaaaaatcactcaaacatcatgaagatattgtagatgaaattgagtgcattgagaagactcttctgaaacgtc

SEQ ID NO: 200 - DNA, 201 bp, Homo sapiens
aagtccaaactgtatgactccctttatgtactacaatacatgctcatgcatgtctgctatatggacagatcctactgtacacacaattgttttctactctytcgattgtcacagctccatttttatcagatttttggaattctgaatgttatccatgtttttaatccatgatttttataaaacttcaatttagtgagtcag

SEQ ID NO: 201 - DNA, 201 bp, Homo sapiens
tatcatatgatatttcatttttaaaaattcaattattaaaatatattatactgatggctacacaccatgtatctgaaaaaaatattagactgagattttayttatatgagccaagaaaccaaaataaaacacccatatttctaatttgagagatcaagcagtgctaaaaatcacataactgtaggcagttctttaatcaat

SEQ ID NO: 202 - DNA, 201 bp, Homo sapiens; identical to SEQ ID NO: 121

SEQ ID NO: 203 - DNA, 201 bp, Homo sapiens
tgtagcaaaaacctaaagcaatgctttgtataagctgcaacagagcattctcctcaggcctgggccgaaggctagcctctgacttttcctgacatgccccrtgccccacaatctaattcaagggatcttaataccttctggcaagtcacataaaggaataagtcaaggcagggggacactttagagaccctgccaatgaca

SEQ ID NO: 204 - DNA, 201 bp, Homo sapiens
tataatggggaagatgtggtttaacagaaatatgtggaaaggcttatgaattgtagttgactgtgtgctagatgatatggcttcccaaaagactaatgctrtcttgagctgcattatgtactcctagatatttgtattttttaaaaacaacattgtaggtgaggctgttcattggcaaaaacatttagaaggcgatctggc

SEQ ID NO: 205 - DNA, 201 bp, Homo sapiens; identical to SEQ ID NO: 124

SEQ ID NO: 206 - DNA, 201 bp, Homo sapiens
tttggcagtaatttgatggcagcatgtccaggggattcaagaatgagtaaatcccctccttcaaataagcactggaactatatattcgaagtcacaattartaataactgaagcaagtaaagaaccacttgattgattactatgcatgtagcaaaaacctaaagcaatgctttgtataagctgcaacagagcattctcctc

SEQ ID NO: 207 - DNA, 201 bp, Homo sapiens
tgttctttaacctatgtaatgctgctttacctcagctagaaccgatagaatctaagtatttgggagaggaagtagaaacacagtgatgaactgtaaggttwtcataggccagtggtggcaggaaagatttgggatactggaaaagtaggctgaatgtcaggtaaggaattgtttggctcagaacatgttgactttgaaggc

SEQ ID NO: 208 - DNA, 201 bp, Homo sapiens
atagtgcgtatccagtactgtacatgggatgtgtgtgtttgtgttctaagtgtttaggttacacatttatgttgccagtcttggattcatcttatatactrggtggtcttgttctttgtatttagcagcaagaactcacagttttggtacatattttttattttatttgtaaattaaactttttttttttttttgagacgg

SEQ ID NO: 209 - DNA, 201 bp, Homo sapiens; identical to SEQ ID NO: 135

SEQ ID NO: 210 - DNA, 201 bp, Homo sapiens
tcttgcacattgtaatttgtaacaatttctttctattcagcatttttctataatctcttaaacgggttcttttactctccaaacttacctggctgtttatrtagtttctcaggtgcacttttatacttcccttcgtttgcatgtgttacttcttcagcctaggtctttccccttccgttcgttcttcaaaacccaggcaaa

SEQ ID NO: 211 - DNA, 201 bp, Homo sapiens
tgtactgtttttagactaaatgtacttataagaacaactgtgtatcatgaaaatcatttttgcatacacctaaccttgcaaatgtaggactcttgatgttraggactagtattgctcatgcagacattttttgttgagatactaactagtacattttacattttatgttatttatgattaactcattcaataaatgttaat

SEQ ID NO: 212 - DNA, 201 bp, Homo sapiens
tttccagttcatttgacatctattttgcttttattcatgcatttcttcaacagatatttattgagtgcttacaatatgctaagcctggggcttataaaagkcacaaaagtactttgaaatgcacagcctatttattattatttgcctgcagagaccagttcatgtattctctgtgattccagtcacatttgcctgttgttt

SEQ ID NO: 213 - DNA, 201 bp, Homo sapiens; identical to SEQ ID NO: 136

SEQ ID NO: 214 - DNA, 201 bp, Homo sapiens
gaaatgctaaaagaaggggaagaacaaacacttccgttatattcgttaagggactagagaattttgaagccagacaaacttgggttgaagcctcaattctrccaccttgtgtaacttaaccaggtctgtgaccctggatatgtgtctgagccttcctgatcatgtttcctcatttgtccaaataattgcgaatcatttttg

SEQ ID NO: 215 - DNA, 201 bp, Homo sapiens
aggaatcggaatcaggatatttgaaaggaggagaagattaaggagtaaaagtatttcagtaggtcagagggtatgggatgaagtagacttggaaagtactsaaatccaattaaagggctaaggagagggatatgggggttaataaatggggatgggtatttgcatattagggagtctgtagagagacagaaggaggtctgc

SEQ ID NO: 216 - DNA, 201 bp, Homo sapiens
taacaggataaattttaagttaaggtatgatattttttctctctctgtacaaaggacttaaaaggaggaggagtcagagatgtaagttcctgtttttacartaactcttttgtgagctccaccgtggtgtaaatcgcagaatctacttttgttcccatgtatttaatgtacaccattggcatattgaaccagatttttatc

SEQ ID NO: 217 - DNA, 201 bp, Homo sapiens; identical to SEQ ID NO: 141

SEQ ID NO: 218 - DNA, 201 bp, Homo sapiens
ggaatggggcatttggctatattgtaatgtatgtgaaataataatcaactttttaaaaacaaaaaaagacggggtttttattcctttcaaactactcaccwtgagagaccggatcatgatatcagagatcctttctttgtataaaattttctgggtttccttcaggattttttttgttttgtttttttgagatgaagtctc

SEQ ID NO: 219 - DNA, 201 bp, Homo sapiens
aagctctctgctttctttgggccagcacttccactggttgttcctggagaaaaaagtcaccatccagtattgtggtgtcattataaactcatagttaccartctcaaatagacaatatgacccttttctgtggtgagcttcctctcccatgcctcactgtttcacaccttctcattcctcacacctgctgtctgctttctc

SEQ ID NO: 220 - DNA, 201 bp, Homo sapiens
tctctacaattttgtcattttgagaatgttttctaaatgaaatcatacagtatgtaaacttttgagattggcttttttactgggtatgatgcccttgagamccagctcaactgctgcatatataaagaattcattcctacgtacggcttagtagtactccactatagagatgttccgaactgtttaaccattcacctgtca

SEQ ID NO: 221 - DNA, 201 bp, Homo sapiens
atttcctgataaaagctcatcttaccactgataacacagttcttgaaggaggcctctaccaaatgttgggggtataaagccaagtgagacacaagccttgytcctgagaaactcaagtcacagctcagtgtgtctttcctcacattgttcctggcataccctcaacaatatctactgaaacttcactcacccctcaaggac

SEQ ID NO: 222 - DNA, 201 bp, Homo sapiens
ttagtagctggattatgtgtttgctttcaacaaatgactgttatatttctggcggacagagagttcaattcccactggatttctgtagagaattatacatrgaaaggaggtaaatgagacatgggaatggcatccaagttttgaagttagctaaaatcaacctgtgcagtggggatgaaacatacaaaccagatttgaatt

SEQ ID NO: 223 - DNA, 201 bp, Homo sapiens
aaggattagaaagagaatgtgtgtgataagaggacagttgtccaagtcagacagccaggttccaggctggactctgctagttaagaagatgtgagaatttrtgcaagtcatataagtcccctggctttgcttttcttatctataaattcaggctaagaatacgtaggcttttcggcatggattaaataaaacagcgtattt

SEQ ID NO: 224 - DNA, 201 bp, Homo sapiens
agaaaagaataaatgcggctatgtattatagttgttaagcatgaagtctgaactaaatttgaatcccaactcaatacaatacttctgaataaaaaaagtgrgtctcaaaacatggtatactctatgagatcatttctgttaaatgcctttatcaacacttatggttgtatttttagtcaataccaaagtacaaaagtggtc

SEQ ID NO: 225 - DNA, 201 bp, Homo sapiens
aacaaactgcaggaaaaacaggtggataggatttttcagataattaaactctcgaagaagacagatgtctgaacaaacaagtacctgaatcatcactcagktctccaaatctgtgaggttgcgggcctcttggctggctgagatggtagctgttatcaccagaaataaaagggcagagtttatgtggcttggaggaagggt

SEQ ID NO: 226 - DNA, 201 bp, Homo sapiens
aagggacctgttaggaggctagcgtagcaatctaggctggagtctatgccataccatctgaatacattcacaagatcttgaaagctaagcagagtcagccstggttaacacttggataggagtgatccaggttggaaacgtttatggcctgtagttaacatgctggatgtggaaatgaaagatagatggatcagttttgaa

SEQ ID NO: 227 - DNA, 201 bp, Homo sapiens; identical to SEQ ID NO: 144

SEQ ID NO: 228 - DNA, 201 bp, Homo sapiens
ctaaaaggcacttcagccattaactttttttcatgtaaaattacagctcctggctcttccactttcaaaaatgtgtgtccataaaccaaataatcattttkatctgaatgtaaacctcatgcaaggacagttaagtagtacaacaaaagtgagcattctttaaacagtgtggacaaagtgcccactgtgaaggggaagaaa

SEQ ID NO: 229 - DNA, 201 bp, Homo sapiens; identical to SEQ ID NO: 146

SEQ ID NO: 230 - DNA, 201 bp, Homo sapiens; identical to SEQ ID NO: 148

SEQ ID NO: 231 - DNA, 201 bp, Homo sapiens
gacaggaatgtagcagataggacagggtgctattgagtttcccaggtctccactggctgtttgctagtactgttcacagtagtcggtgagaatgccatggwcacatttttcttttctatgttatggagttgcaaagtctaataataagattgataggattcctgggcatagtaataaaaagttggcagtttagctgttctg

SEQ ID NO: 232 - DNA, 201 bp, Homo sapiens; identical to SEQ ID NO: 149

SEQ ID NO: 233 - DNA, 201 bp, Homo sapiens
ttgttaaatcagtataatgaaaagacaaagttgagagttacacaaacttgaattcaaatcctgtttcattcacttacaaggctttgagctttgggcaagtygcctaacttctttgatcctgaatttcttcatctgtaaaattaagatgatacttacatgataagttgttgtgaggagtcacaaatgaaatagtgtatggaa

SEQ ID NO: 234 - DNA, 201 bp, Homo sapiens; identical to SEQ ID NO: 150

SEQ ID NO: 235 - DNA, 201 bp, Homo sapiens
tattacaggaagaacagattgaccaagcttgtctgagatgccaaactcaacctcacttgtgaaaagtcaaacactgtcatttgggaaaagtcaaacacttytgaaatgtaaacaaagtttcatttattaacctgggttaccaacaggcataatcaaggtacaatcttttaagtaacaaaaattcatattattttgaaatgt

SEQ ID NO: 236 - DNA, 201 bp, Homo sapiens
ttccatcctgaatgttctgatagattttcttggcagcctcaaggaaggcatcttctacattctctcccctaagaggcaattgataactttattggagaacyacagttttctacaaaagacaagacactgaccttttgctaatctttagttaactgccatgatgtctccaacttaaccactgtcatctaataagagattacc

SEQ ID NO: 237 - DNA, 201 bp, Homo sapiens; identical to SEQ ID NO: 154

SEQ ID NO: 238 - DNA, 201 bp, Homo sapiens
ttttgacttaccaaagggcagactgaaagtcagctttgaggaactgataaaattaattggctctcttagaatctcttttatattttgagaaaggaagtaartgatttcatatcaatttcatagaatgacttttctttacagacaacaaaggaggctttgaaaatgttttagaagaaattgctgaacttcgacgtgaagttt

SEQ ID NO: 239 - DNA, 201 bp, Homo sapiens
gagattgacagaagtcgagcaggagagagaccagctggaaatagttgccatggatgcagaaaatatgaggaaggtatgatttttttcctgcctattttccktagcttcataagtagataatgtccaaattaagttagttggaggaggtaacagtacatttttaagtgggaaaaagtattagtggctatatggtgatttttt

SEQ ID NO: 240 - DNA, 201 bp, Homo sapiens
aagtctaataataagattgataggattcctgggcatagtaataaaaagttggcagtttagctgttctggtaaatttggctttagccacttttctttgttckcatttatgaaaagagttgataaattatcattatgaaaagtaatctaacatggagctaaagctgtttattctaaaaatacaatggagagactctataattg

SEQ ID NO: 241 - DNA, 201 bp, Homo sapiens
tgatttgtaacttcctttaagtatgttatgatttttaaattaaattataccaatactaatgttatatcatttcagctccaagatataagcaagttgaaacygcttcaagatttgatttctctgatcctagttgaaaatccagttgtgacccttcctcattacctccagtttaccattttccacctccgttcattggaaagt

SEQ ID NO: 242 - DNA, 201 bp, Homo sapiens
tatcccatcatctatgtccaatatgagatctaggtcactttcacctttgattggatcagagactctaccttttcattctggaggacagtggtgtgagcaarttgagattgcagatgaaaacaatatgcttttggactatcaagaccataaaggtatcactttttaatctaagaattggtctgaccacatacttcaagtaga

SEQ ID NO: 243 - DNA, 201 bp, Homo sapiens
aggcaggttcatccatgccgtggtggtagtgctaggaaatgtttttccaatgaatggatgaagttatgaccactaagattcttgactaagaagacctagtmcaagtttctcacagttttgagatctattatttattcattggatatatgtggagtacctcctgtgtatcaagtattgttctaggcagcagtgaacagagtc

SEQ ID NO: 244 - DNA, 201 bp, Homo sapiens; identical to SEQ ID NO: 156

SEQ ID NO: 245 - DNA, 201 bp, Homo sapiens
aatttgtacatatggtagaaaaaaatggaatcttgttttaattttgaatttttatagttgttggacagttgagtattgcatatatatttattggctatttygtatttcctctttaaattgccagttcatattggttttgcctattatctgttagtcccaaggactattagatgcctaaaataattctgggtcttattctaa

SEQ ID NO: 246 - DNA, 201 bp, Homo sapiens
ataattgccaaaagatactcttaaagtatattacctatgagctttgggaataatgatctacttcatctcaagtgtcaaaaaaatcatattaacagttcttytgtccagatttggcatagtgaatggtaccagaatacaggtgtttgcttttaggtcagtttgttctctcttgaaccatatataaatgaagttgacgtggga

SEQ ID NO: 247 - DNA, 201 bp, Homo sapiens
agggcctgggcaggcttctcaaaatttttttttaaaacttaagacctgtaggatgcaaaatagcccagtaggaggtagaggaagacagttctagggaaagygtgtgaataaaagcctataggtgagaagaggcatcacaaatctgaagaaatgggataactttaagaaagctgcagtagagtatgcttgaagatgaggcag

SEQ ID NO: 248 - DNA, 201 bp, Homo sapiens
atgtgattgtctatgacataaaatccattcaggagcaaagcacccattggcatcagggaattcagtgtctggttataagaagaaagagttttaggatctasttttgcaatgctgatttaaactgcgacatatccataatagtggaaaaggaagacaataggccatagtggtttttacacatagggctcagtgtaaaaagat

SEQ ID NO: 249 - DNA, 201 bp, Homo sapiens; identical to SEQ ID NO: 159

SEQ ID NO: 250 - DNA, 201 bp, Homo sapiens
actcagcaataagaagggaatgaagtattgatatacacaacatggatgaatctcaaagtaactacgttgagtgaaagaagccagaccaaaagcaagtccamactgtatgactccctttatgtactacaatacatgctcatgcatgtctgctatatggacagatcctactgtacacacaattgttttctactctttcgattg

SEQ ID NO: 251 - DNA, 201 bp, Homo sapiens
aggttgaccaggctagtcctgaactcctgacctcaggtgatccacctgcctcagcctcccaaggtgctgggattacaggcatgagctaccgtgcctggctyatagagagtttatttttatttttattttcaagacagagtcttgctctgtcgcccagtctggagtgcagtggcatgatctcagttcactgcaacctccacc

SEQ ID NO: 252 - DNA, 201 bp, Homo sapiens
aagttaattatatatggtcaggaagtagagccacattatacattttaaatagagaagaaacatcaaaagaaaacataattatttcaaatatatgaaatggrcatttattcttggagcaaatattgttagcctgatatgagcctatgttttcagagtggcagcagtcatttgataaagcaataatttgcgcttaggagatgg

SEQ ID NO: 253 - DNA, 201 bp, Homo sapiens; identical to SEQ ID NO: 160

SEQ ID NO: 254 - DNA, 201 bp, Homo sapiens; identical to SEQ ID NO: 161

SEQ ID NO: 255 - DNA, 201 bp, Homo sapiens; identical to SEQ ID NO: 162

SEQ ID NO: 256 - DNA, 201 bp, Homo sapiens; identical to SEQ ID NO: 163

SEQ ID NO: 257 - DNA, 201 bp, Homo sapiens
tcaacattgtactggaagatctatttaagcataaatagtactaagcaccaattactaatctgaaggcctcctcacaggtccaagggcaatgagcaacctcragaggcaggtgactgcacaagcagtaagctatggattaaaaattaaaaggatttcacattctttccaaagtgtactgcccggtgtctggcacacgcatgt

SEQ ID NO: 258 - DNA, 201 bp, Homo sapiens
tactccatcaaacacgttattatccataaaaaagacttcaacattgtactggaagatctatttaagcataaatagtactaagcaccaattactaatctgarggcctcctcacaggtccaagggcaatgagcaacctcaagaggcaggtgactgcacaagcagtaagctatggattaaaaattaaaaggatttcacattctt

SEQ ID NO: 259 - DNA, 201 bp, Homo sapiens
ttctctaaaatgccacatgaaccctctctatattcccacatgaagaggaatggaaggtaattatttggtcttttcttctgtttaggggaatgaactgaacsactcatttttttaaaatcacacttaaaagacacatgggcaaaaaagttccccaaaactactgtcttaccgaatttgagaagggaggtaatgtatgaagct

SEQ ID NO: 260 - DNA, 201 bp, Homo sapiens; identical to SEQ ID NO: 164

SEQ ID NO: 261 - DNA, 201 bp, Homo sapiens
taagtgtttaggttacacatttatgttgccagtcttggattcatcttatatactaggtggtcttgttctttgtatttagcagcaagaactcacagttttgstacatattttttattttatttgtaaattaaactttttttttttttttgagacggagcctcgctctgtcacccaggctggagtgcagtggcgtgatcttgg

SEQ ID NO: 262 - DNA, 201 bp, Homo sapiens; identical to SEQ ID NO: 167

SEQ ID NO: 263 - DNA, 201 bp, Homo sapiens
gccagcatgccatcttccagacacctccacatgttcagctaattggaagttctctggaccctgtccttttggggttttatggaggcttacttatgtaggcrtgattgctcacatcattggctactggttatcaaatcaattttagctgctctcccctccttaaaggttgtggggttgggcttaaagtcccaaccctctaaa

SEQ ID NO: 264 - DNA, 201 bp, Homo sapiens
aggtataaggcagcaaaacagtgaaagtgtgtgatttccttgcccttcgttagattctttgatttttcttacgacaagtaattcctgctaatgagcatggwgtttctttctaaaattagattgtggtaatgtttgcacaacttggaatatactaaaagcctttgaattgtacactttaaataggacatgatatgtgaattt

SEQ ID NO: 265 - DNA, 201 bp, Homo sapiens
agtcttttgggtgaccccacgtggccattctagtttcatctgtgcttccaatcccctgatgccccacatatacccaccatttaattcaagaaaaaataacyaaaaaaaaattatttaaagaccacaagcccttagtgattttgcctttgcaaatttggtaaggcaattagcagtaggtataaatttcatatttcactaagc

SEQ ID NO: 266 - DNA, 201 bp, Homo sapiens; identical to SEQ ID NO: 171

SEQ ID NO: 267 - DNA, 201 bp, Homo sapiens
tatttaggacatattcagtttgaaatgtctgtgagacaactaagtggaggtggcatagagtcagaaatgtgagtctggaatttaaagagatctggactagycatacaaattttatgctcagtcacatcagcataaaaatgacattaaattgcatgggaatcagctcactcaggcagtggttgggagacgaaagaaaagcag

SEQ ID NO: 268 - DNA, 201 bp, Homo sapiens
tgtgagttataggtctttttggacatggaatccatcttttattactaagataaaatataatatctttatgctgattccctggtgcacgttactcagcccaytgaaaaccttggcaaaatgtcagaccttaagactttccactatcccaaaactatgaactgtagttgcctagttttctcttttgcttatttataatgttat

SEQ ID NO: 269 - DNA, 201 bp, Homo sapiens; identical to SEQ ID NO: 174

SEQ ID NO: 270 - DNA, 201 bp, Homo sapiens
atttgtgcagtatagaaaattgaccaaagaattaaattgacaaataaattagaagtgacttgggaaaaaccttcatcaatcagaattcattaatatgtgtkataaatgctttatttaaaagttctggttaaattacttatattcctaaatacagtatcatctatgggctcccatatcctgctggcatagctaatcttttta

SEQ ID NO: 271 - DNA, 201 bp, Homo sapiens
atgcagaactcagatatggagagtagactgtatattattattcagcatcttaactttcacaaaacagcatacgtggacaactctccaagttaaaaaatatrtgtacatgcatgtataaagccttcttactctttttaaagtctatgttgtgttccattaaatgtattcttcataatttagttagcctattcctattgatgg

SEQ ID NO: 272 - DNA, 201 bp, Homo sapiens
taaaatggtgtagtatttgcaagtgactttcgtacatcctctagtatactttaaaatcattgctagattacttataatacctaagacattgtcaatgctartaaatattatattgtttaggaaataataattaagaaaaaatatctgtacatgttcaatacagatgcaaccatccttttaaaaaaatatttttaatccgtg

SEQ ID NO: 273 - DNA, 201 bp, Homo sapiens; identical to SEQ ID NO: 175

SEQ ID NO: 274 - DNA, 201 bp, Homo sapiens; identical to SEQ ID NO: 176

SEQ ID NO: 275 - DNA, 201 bp, Homo sapiens
tattttttgtccaaaagtttgtaaagtttataatttttgtactgtttttagactaaatgtacttataagaacaactgtgtatcatgaaaatcatttttgcrtacacctaaccttgcaaatgtaggactcttgatgttaaggactagtattgctcatgcagacattttttgttgagatactaactagtacattttacatttt

SEQ ID NO: 276 - DNA, 201 bp, Homo sapiens
atacctccttagggccctccattttgagactcaccgggctaagtggtctttgaggtccctgtcagctctcagtttattgaaaagccaaatgtttgtttgtrtaagagattgaaagtgaatttgaatttcaagtattttatctatttcatacctctattttcttctaagaaaccttttttaaaaagtagatttaattttttt

SEQ ID NO: 277 - DNA, 201 bp, Homo sapiens
gttcttgaaggaggcctctaccaaatgttgggggtataaagccaagtgagacacaagccttgttcctgagaaactcaagtcacagctcagtgtgtctttcytcacattgttcctggcataccctcaacaatatctactgaaacttcactcacccctcaaggaccagctcaaacaccactcctctgtaaagctgctttctct

SEQ ID NO: 278 - DNA, 201 bp, Homo sapiens
cttcaatctactttgcagcacagttatctgcatatctgctggttctctccctgctagactataagctctttgggaccaaggatccatgtttatctttgtawactgcagagtctagcatggtggctagcctttaaaatctcaataaatatcatctcagtctggttaagaagctaatgttttaacacatatagaatccttttt

SEQ ID NO: 279 - DNA, 201 bp, Homo sapiens
ttatctgcatatctgctggttctctccctgctagactataagctctttgggaccaaggatccatgtttatctttgtatactgcagagtctagcatggtggytagcctttaaaatctcaataaatatcatctcagtctggttaagaagctaatgttttaacacatatagaatcctttttatttttgactgaaatttttatcc

SEQ ID NO: 280 - DNA, 201 bp, Homo sapiens
gaaatgggcagaaacaacaaatgcagtaaacttcaaagccagaaaacaaaaaaacaaatgaacagaatattcaaaagtggagtggaggccgggtgtagctrttcacacctgtaatcccagcactttgggaggccgaggcagatggatcacttgaggtcaggagtttgagaccagcctggctaacatggcaaaaccccatct

SEQ ID NO: 281 - DNA, 201 bp, Homo sapiens
tctaaattctcttgtacctgtaagtttattgagataataaaggaaataaacttttatgcctctcgttctgtcagacttagtagatactggattggcactgrccacctctagtaaagatggctttattagtagtttccacttgttctttcacctaaaggacctgcttcacaccaccaagcatcaggatgtgttgctcagtga

SEQ ID NO: 282 - DNA, 201 bp, Homo sapiens
tggcaatcactaatctactccccatctctacaattttgtcattttgagaatgttttctaaatgaaatcatacagtatgtaaacttttgagattggcttttktactgggtatgatgcccttgagaaccagctcaactgctgcatatataaagaattcattcctacgtacggcttagtagtactccactatagagatgttccg

SEQ ID NO: 283 - DNA, 201 bp, Homo sapiens; identical to SEQ ID NO: 183

SEQ ID NO: 284 - DNA, 201 bp, Homo sapiens
atatgtttgtgctgtcaataaatgttttgtaaactgtcagaagtttttgctttttttttctatacctatttttgttagaagtcagactgtgctcttctctrtgtcattatgttatttttatcattaaccatttaaaaacatgtttatgccaggcgccatcgctcatgcctttaatcccaacactttgggatgctgaggtgc

SEQ ID NO: 285 - DNA, 201 bp, Homo sapiens; identical to SEQ ID NO: 187

SEQ ID NO: 286 - DNA, 201 bp, Homo sapiens; identical to SEQ ID NO: 188

SEQ ID NO: 287 - DNA, 201 bp, Homo sapiens
cttaaggaagcaaagtggagtgtgaacaatagtttcctgaggaagtgttgggttttaattgtgttgaggagaagaaccatttccggaactgtgtgtgcctrtgatgcctgcggagttggcttggcacagctatttccagactaatcctgagtcctatttataggctgagatgattaggttggcctgtgtcaggagaggccc

SEQ ID NO: 288 - DNA, 201 bp, Homo sapiens
cacagcatctgactccagctttgctcctgcagatctggagaatcgaaggttccaacaaggtgcccgtggaccctgccacatatggacagttctatggaggygacagctacatcattctgtacaactaccgccatggtggccgccaggggcagataatctataactggtgaggttctggggccattggtgtgtgtcgtgggg

SEQ ID NO: 289 - DNA, 201 bp, Homo sapiens
aaactttcactattttctgatttgtcattgaattccttcccgcagtggcgtcaaaagcctggacaccagccggggccgaggtcctgcaggtatttggggamctcccctagcccactgatatctgcatcattagtattcttactattctcacctctcagagatcacagtaggtgaagctcttcccatactttctgtcactgt

SEQ ID NO: 290 - DNA, 201 bp, Homo sapiens
tccttgcagaatgtcttaggggactagtgtgcctttgggaaacgccggttttgaggaaggaattgttgcagtttttttgatttagaaagtggctacagggktccttgttagtggagtatgggattcaaaggggtggcagaaagatgcagtgggcagggaatctctcacttcttagctgtgtggccttgggcaaattttatt

SEQ ID NO: 291 - DNA, 201 bp, Homo sapiens
gtcagggagggtgagtgagaagcattccctatgcttatttgaccgtggaactctttccttgcagaatgtcttaggggactagtgtgcctttgggaaacgcyggttttgaggaaggaattgttgcagtttttttgatttagaaagtggctacaggggtccttgttagtggagtatgggattcaaaggggtggcagaaagatg

SEQ ID NO: 292 - DNA, 201 bp, Homo sapiens
tccccaaatcgcacatgtgcaggatgagaaagatacaatttgcaggcaaaagacttagaaatttaattattaataatcagggtaataattagagtaaacayatgccttgtgcaaaaccctgaacatgttttatctcatggtaggttctaatattatccctctttgaacagcaaaggcaactgagactccgagaagtgatgt

SEQ ID NO: 293 - DNA, 201 bp, Homo sapiens
ctcaacctcccaaaatgctgggattacaagcatgagtcaccatgctggccctgcctcacttttgaggctgtttttccatcaaacctgatcactttagggarcaagggagatcagtttcttgcacaactccccgactaccctgagaggtgggactggaacccaaggctgtgctgtgagtgtgagccgcattctccagtgggg

SEQ ID NO: 294 - DNA, 201 bp, Homo sapiens
tggcggggcacctgtcccttacccatagctgctctgaagggactgctgggtgggagttgctgcggtaccgtaggggaaagcagaagggtggcatgggctgsaacaatccagaaagacttcccagagagccttgaaggatgagaaagatttggattagtacctctcaaagtggcttttgcaaaatactcaagctggaggcag

SEQ ID NO: 295 - DNA, 201 bp, Homo sapiens
tatttttgctgtagagggaaacactatctctatcctccaagcctgccctacaaacatccttgaaaagacagtctaggacaaagggcagtcagtgcctatgytcacaaaatgtacagaaacatgagacccatggaaggtcatctcccaacaggggcaggattttttgtattgtagaatatagtactgtatttggtggaggga

SEQ ID NO: 296 - DNA, 201 bp, Homo sapiens
agtgaagaacacatcagttccttcagaaaccctgaggcttctcaaagaaggctctcctctgttccaggagaaggaagggacagatgagaagtcacttcaasttcccagaatactcagaagctgaacttgtcaaggtttagatgtggcaaagcaggccaggcatggtgactcatgcatgtaatcccagcattttgggaggcc

SEQ ID NO: 297 - DNA, 201 bp, Homo sapiens
gagggtgcaatttttggttcttccacatcagggtatcctgatgctgtgccttggtacggggcttgtcattgggcagtcctgggaaatgtgcactttcccakgattctctcagctctttgcattttttagtttacccggccagtccttgctaagctgctgcagtggagagggaggtgaagcagacaccaccgggccctctga

SEQ ID NO: 298 - DNA, 201 bp, Homo sapiens
aaactccatggatcatagaagtagagactcatgggtacttcctttcaagaacctccgctttccttgatgtttgctttgtggctgaggagacaaagtggctsgatggcactctcagcttacaattcagaggaaccattgttgagtcccctgatagaagttttcatcccttgggctttgtggtggattaaagacggctacaaa

SEQ ID NO: 299 - DNA, 201 bp, Homo sapiens
tggagagaatgagtaccattgctgaagccttgtcactccccccaccgcacacacacagcaacatcctcaacgcccctttctgttccatacctctgttcggytatccccgaattggccggccagcctgagctgtccagagccctttcacagcagcactggggtgtgttaaaccctgggctccagaggcaaacaggtctgggc

SEQ ID NO: 300 - DNA, 201 bp, Homo sapiens
cgtagccctgttccttcctgtgttcctgagcagggtggtggagagcccacgtgggtatcatgcctttaaaggaggatggtgcccagggcagggggtgggcwgtagggacagtaggaccatagaccctcttctttgtcaactcctgtcctgagtcaccctctccctggtgtgggaggcactaagaattcctggggtttcctt

SEQ ID NO: 301 - DNA, 201 bp, Homo sapiens
aggtcgccactgttaacaatggtgtgtgcactcctgccaaacacgttgattggatgccttcacttttagccatccagtgacagtgggtcactttcccctamtccatgtgaatagtttgggtcatttgtgatgtgggtcatagagatgatttctgcttggtctatggtacgttgctgagacactgagctctggttttcttta

SEQ ID NO: 302 - DNA, 201 bp, Homo sapiens
gcagcacaatcatggctcactgcagccttattctcctgggctcaggtgatcctcctatctgagcctccagagtagctgggaccacagacgcatgccactaygctggataatttttaaaattatttgttgagacgggatctccctatgttgcctaggctattctcgaactcctgggttcaagtgatcctcccacctcggcct

SEQ ID NO: 303 - DNA, 201 bp, Homo sapiens
cccccactactgttcttttcctgatctaggatctaacccaggatcccacatggcatttactcatcatgtctccaaagtctctgaatctatggcagttgccyggtctttcctttttttcatgcccttaacacttttaaagggtactagtcagttattttgtagaatgtctctcaatttgacaaccccagacatttaaaaaca

SEQ ID NO: 304 - DNA, 201 bp, Homo sapiens
cttctttctccttttttggcttcctcaatagtacttccttctttctctctaccagttcctctgttctctcgttctttagcagaagacttgatgacctattwaatctagagtctggatcatcagcaattaaaacaagccaaaaaagaaaaaagatcatttccttttccttaagcggtcaggagcgctcagccttcaaactgc

SEQ ID NO: 305 - DNA, 201 bp, Homo sapiens
gttcaagaccagcttaaacagcatagtgagaccccatgtctacaataaaataaaataaaataagtaagctgggcactgtggctcataactgtagtcttagycactcgagaggctgagatgggaggatcattcaagtccaggagtttgaggttacagtgagctgtgattgtaccaatgcactgcagcctgggacagagtgaa

SEQ ID NO: 306 - DNA, 201 bp, Homo sapiens
gtgcctgcaggaagatgggactgacaactccctggatatctatctgtttgggcagcactgatctgctctgccctattgcttcctgcacaaaggagaacacwgatggagagagacagcactggaggggctttggatggtgtggggagaaccttagatgaagaggggctgaagttgcttccccttatcccttcctcccacctt

SEQ ID NO: 307 - DNA, 201 bp, Homo sapiens
ctgccttctagtggctctgtgagttgggcaaaccatttaactccagtccgagcccaagtgattaaaagttcatcccatggcctaaccacaacctaccacaytgcggtttcctggcttgcctgagctggggggtgggggtgctgcacagcatctgactccagctttgctcctgcagatctggagaatcgaaggttccaacaa

SEQ ID NO: 308 - DNA, 201 bp, Homo sapiens
ttgtccagtgcttcggccttggtcccagcgccttcccacggagcagcactcttcaccctgcacagccttgttaggtaggtagagcaatacagacacctgtygtcctcttaaaccccgccctggctgcccagggaagcctggaggggacttcagtggtggaagcagccgctgtagccacagtggattcagtgggagtccctg

SEQ ID NO: 309 - DNA, 201 bp, Homo sapiens
gtgctcgaaaatggttaaaaataatgaaagcacctaggccacagcagaacctagtattcaaccacggaggcaaaggcccaatgtactgtggatcagaaagratgtttttggctgtaagcagtggagggctaactcaaaccaaattaaactgtaagcacacttatgtgctctcatacataatcagttcagagttgaggggga

SEQ ID NO: 310 - DNA, 201 bp, Homo sapiens
tgcattccagcctgggcgatggaacgagactctgtctcaaaaaaaaaagaattattttataaataaatacagagaatttttaagaagtgagatttatgacrtgaagcaacccttttcctttttaaaaaatagggtaaagattttaataacaaaaatgaaaggcatacttcaacaagtaaaatatttagaggggtaaaaatt

SEQ ID NO: 311 - DNA, 201 bp, Homo sapiens
agtcaggagcccggagtccctgccacacctctgccgtgggatgctataagttctgcccccttgctgagcctcagtttcctaatctgtgaattgatctgatkctcccagtcctgagtttacgctcaggagggctgagaatgaacataagggaatgtgacagagctgggaggacgcttagagaaaaatgaggtccatcgtcct

SEQ ID NO: 312 - DNA, 201 bp, Homo sapiens
ggctgggcaggcccaggcctggacttggagcccggagaactcaggtatccctctggggccccccacagacaccgagacaaagttcagactcttcagtgtgrcacacaggcctcggtgacccctgctgccctctgcagcctcctctgctcttgctccctgtgtttcatactggacccctggtaattcactggatatggttat

SEQ ID NO: 313 - DNA, 201 bp, Homo sapiens
tggtttatgcttccattaagagcctatgggagctgtggggttttttataatatcatcctccaaatggctagggggaagggagagctctctgaatttaggcyagagctggcccactgcaggctgggcaggcccaggcctggacttggagcccggagaactcaggtatccctctggggccccccacagacaccgagacaaagt

SEQ ID NO: 314 - DNA, 201 bp, Homo sapiens
ccactgggtttcataactggcttctctgtttactgaccattgtcccaattagcaaaatccctggtcagaagggcgggtgctcctaggaggacccagagaayagcagtgagccaaaaagtaaatagactccaagagagggctttccatgagtggctggctgcctggaaaatcaagaacaacagtgtttggagtgaagagaaa

SEQ ID NO: 315 - DNA, 201 bp, Homo sapiens
aaggttgctctctgtttttctccctcttggaaagtccttcctctgcagagcaggaagctgcctcctgtggcttctcctgctcattctggcttgggttgggrcattgtagaccctgccttcccctgcagctctgcagagcctgtgactctccaaagtcttctgctggttccacggtcccagcatctgcagccaggcctccct

SEQ ID NO: 316 - DNA, 201 bp, Homo sapiens
tgtgagaagcattgcattgggagccttgccatcaaagccctgaatgaatcctttttgtaacaaatctgttggtaaaatataatgcactatttataaagagmctgattattcccaaatcaaccatttgcacacatctgtgtgttcatgtgttaggttttcttaatacaggctacccttgcactgttgtcagttgaagggaag

SEQ ID NO: 317 - DNA, 201 bp, Homo sapiens
aacttggttctccttctggtttatgttttgcacttgccctaagaccttgaggacatcacctcactgagtttcatttttctcagctatacagttagggcttyaatacccacttcacagaattctacaaagtacctaacacaatgcttggccagtgcaatcatgtggatgctgggaatttgtattatctcatctgactccaaa

SEQ ID NO: 318 - DNA, 201 bp, Homo sapiens
aggggtcgcaccagtgggagtggattcgtttattctgctgagctggctaagcaaacagtcctgttattttccaacctcaataagaatatcatcagagccargcttatttgccaagcaaagtatatatattctacatatgtgagccttcagggtggggcttggcccttaatttccctgctacagagactgtggctgagctgg

SEQ ID NO: 319 - DNA, 201 bp, Homo sapiens
ataatgtcagccttcccagctctgatggcctctgagttggagggctttgtgctccccacatgtacttgggtccggcatgtctgagacacaaagtgagcccrcagtggtgcaactggtgattcagctactgttcttgaatttaatcttttcggactgaattgattgccccattttgcagataagggagttgaggcctaggat

SEQ ID NO: 320 - DNA, 201 bp, Homo sapiens
tggtgctagttgagcattgctcgcttgcccgtcccatctgagctctttggccccagcccagctcaggagctgccctgggtctcctccccgaccctaggccycttcagatctcccctccgtgctccgggcctcagtttcctccaggggaaagcagagggcttggtttggtgccttcctgcgaggtgaagcgaggggtccccc

SEQ ID NO: 321 - DNA, 201 bp, Homo sapiens
cataacaaagtatcatgaactgggtggcttaaaacaacagaaatgtattgtctcacactctggatgcctgaaatctgaaatcaaggtgtccacaggaccayattccctctgaagaggcaatggaaggagctgttctccagaccgcactcctagcacctggcagccacaggtgtttcttggtttgtggctgcctcactctaa

SEQ ID NO: 322 - DNA, 201 bp, Homo sapiens
aaagaaaatgctcaagaaagagcatcttggctcttttgaaaggagtcatcttttagacctgatcttgcccctttaatttagagaccaaagcattataactmagaggctgatactcttgaggaggttgagaggtaaagtccaagagacccagataatgaggacattattaggtaactaactatatcactgtgtacaatgcaa

SEQ ID NO: 323 - DNA, 201 bp, Homo sapiens
aagaaagagaatgtactggaagtatattgggtggctcctggaaccaaaagagaacttcaacaatcaggcctcgggagaggcaaaaattcctggacatctcyttagggcctgctttccagatgattctgcgtcaatatccttctggccaagtatcctttttctcaagatacaaattcttggaagagtcagttgggttagctt

SEQ ID NO: 324 - DNA, 201 bp, Homo sapiens
atcacaatgcaaaaggagtccattgctctgcaagaagataaacacctcttattaaactcggatacatcatgatttgtaaatatttgattcctgtgaaggaragaaaaaagctaatgcaagctgtttgctgctcagtaagtgagggctcactctctggttatggaactgagcaaaatgcttatggcctcccctctgtctcca

SEQ ID NO: 325 - DNA, 201 bp, Homo sapiens
tcataattaccatcattattattactctaagggcctttgcagctttaaaatctaggataacatgtcagagaaaagctaaaacagggaggaaacagaaaagwttcccttaatacggcttgaatcagtacttgcaagggagagatttttctggaagatggcttgtgtattcatcataaggcctcatttaaccttggtgactca

SEQ ID NO: 326 - DNA, 201 bp, Homo sapiens
ttcttccatcagaggagatccttatcagcaagacattcactctgaggtgaggatccaggacaaacaggccttaccttacctagatccaatggggggagaartacaaagaggtatctagaaaggaatgaagacaggataccaagaagacttctaggcatccatgaaaggcagacttgatatatcctgccagctataaaatac

SEQ ID NO: 327 - DNA, 201 bp, Homo sapiens
gatatctgatacaaatctagaagattgcagaagcagacattttgagaaggtatcttagccttactaattaacgtaaattgatatcaacatcttgcctactygttaaaaggctactccagttattggatttctgtggtgattgttttttaaaggttagccttgaccaattctattacaagttttttttttttcccagcagca

SEQ ID NO: 328 - DNA, 201 bp, Homo sapiens
tggcaaaagtaactttgatggtcttctatatacaggaaataaagtattctaatactggacctctgtttacagaaagaaagcacttaacaaccaaaaagccraaaaaaacccctgcacttactgctcaagttaaaaggattaatagtgaaaattttactaccgatattgtgtctgagatttgcttcaaaataatttggcaag

SEQ ID NO: 329 - DNA, 201 bp, Homo sapiens
cattttaccctaacaggtagggtatctgttagcaccattttataaatgaggctactaaggcacagagatgttaagcaacttttccaaggtcacacagctartaagtgattggactagtgtgcaaacccaggtgtgaagggcctagcacagacctggttcagagtagacatttggaggctccctgatctttgatcctcgctc

SEQ ID NO: 330 - DNA, 201 bp, Homo sapiens
gagtgtggcataatgacacaagctaaccatctgctggaagatatagcaaatgtgtgaggggtcacctgttcctgggaagatgcctggaatcctccaggtgygcaggttgtttgtcacctgctctggcttcatttctgcttgtatttttataaattgttttgtaaaaagtagatgttattttatccttcatctcttcccaga

SEQ ID NO: 331 - DNA, 201 bp, Homo sapiens
aagccttgttacccattccagtttggcatgttctaacacatttataatcagtctcctgcatcacagaaaactcccttaaccagttctttcaggaaagggastttttctagttagattaactgattctgaacatcacaacaactttattcccttttccaggcactaggaactcaaaacttttaagaatgaacttggtcctga

SEQ ID NO: 332 - DNA, 201 bp, Homo sapiens
ttgctctgcctcatggggagcctcttcacctcttgcattcagtgcctgggttaagggatgagaacagttttcttcctgggctataaagtatccctgaaatygactcttcccaagagtgatccagaaaggctttaagccatggagcctcgcagggaactccagtgaaggggtcgcaccagtgggagtggattcgtttattct

SEQ ID NO: 333 - DNA, 201 bp, Homo sapiens
tctcctttctggtttgggcagcaatatttttttccacttcctgttttctggtgtctgattcctcaataaacaaggtcatggtgagaaatagccacatgtawacctggggactttctgccctggtcaccagtgattggaccaggtgggcacgtgagcaagctgggccaatcagagtccttctctgtgttcttgaaattaggg

SEQ ID NO: 334 - DNA, 201 bp, Homo sapiens
aggtgacctggccgaatgtacccattttacagatggaaccctgaagctcagagacttgtaggtcctggatttggttgtacaaccagtatctggtactgctygggctaggaaagaggcttcgagtcagagcatcaggccctaccctgtattttgcatatgaagacactgaaacccagaaaggtacagtgacttgcccaaggt

SEQ ID NO: 335 - DNA, 201 bp, Homo sapiens
cctcattggctttctctgtgaatacgatggaagatggccacctcaaaatggcagccttggccttcagagatcattggtcctcacagacccagttaattaaycatgattgtcatgtctcaacttccagctccaaattctaatagtccagcttttttctgccgtccactcctcatgctgtcaactgtgttgtgggggaaggtt

SEQ ID NO: 336 - DNA, 201 bp, Homo sapiens
gctgtgctgggcattttcacaggaagcagagattgagatatctggccctgccctcagggagctcgaagtctagtgtgggagatggtaaacaacccagtaakgaaatcattacaaataaccatcacttacaagggaattaagcagagttctggagtggagaataacgagacaggggagcctatttcagcagaatggtccaga

SEQ ID NO: 337 - DNA, 201 bp, Homo sapiens
gtagcttcccctctctgggcctcaattttcctatctggaatgtagagaggttagttgatcttttcagttcaattttatttttcagaccaaaggaccacagycttgcagggcagttcaagtagatggggctctatctcctcttccgttctctcccaataaccacctccccaccaaaagaaaaaacccatagcaaaaaaatat

SEQ ID NO: 338 - DNA, 201 bp, Homo sapiens
aagcacaggcgcacagacccagaccccggccccggcccggcccggctgcagggccgggctccccacatcgacaaggacaccggagctgccccgagacgccragagggctgcgaagagctgcctttgtactcagagccagacgcggcctacgggacgggaccgccacgtctggggcttgcgggctgcagggcggcgcggcac

SEQ ID NO: 339 - DNA, 201 bp, Homo sapiens
cctgagacataggtgaactaggagcatcttttattctaatatttggtctttgaccccagctcctgacacagaactcctaattccttggaatttcctaggtrataggggtatctttgtttcaataaggcaactcttattgggctcccggatgggggctggtcaccagaaaggccaagccactgttagaagcttggcgctttc

SEQ ID NO: 340 - DNA, 201 bp, Homo sapiens
aggttttgtttggcttttttaaatatttgcagatggtataattccatcttgaaaacaagggaatcaactgaaaagctcttggaaacaggaaacttcaaccmagtatcaagttactaactggaaataaaaataatgccatacagatcaattagaaagaaagcataaaagaaccaaagatgttattcaacttagctacaaagg

SEQ ID NO: 341 - DNA, 201 bp, Homo sapiens
gcactttcccaggattctctcagctctttgcattttttagtttacccggccagtccttgctaagctgctgcagtggagagggaggtgaagcagacaccacygggccctctgagatccactctaatccaagacggagacagtggaagttaacgcccagagtgctctgtgataagtgccaaggggctcagggagacaaagagt

SEQ ID NO: 342 - DNA, 201 bp, Homo sapiens
gggcctcagagcagctcggcctctgattgaacttcactgacccacagggagcgcccttctcttgcagaatgctttggcagaatagtacacaggaagcgtgygggctttttttttcttttttttttaaaaacagctttattgaaatataatttacatgatttattggagtaaatttacatataatttacatacacataattc

SEQ ID NO: 343 - DNA, 201 bp, Homo sapiens
gccgggcccagaaagctgactcaccccatcagcggctatccaaaggttctgctgacaaagaggtagccctagtgctgccctaataggaggacttgagggcygggtcttggctctgatgcatctgcctttgagactgagccctgataactccaaaagccaagttgcctcaatgtaatctgtcaacaaaaagaatgttatgct

SEQ ID NO: 344 - DNA, 201 bp, Homo sapiens
tgtattttgcatatgaagacactgaaacccagaaaggtacagtgacttgcccaaggtcaccaggaagtcagtgtcagagccagccctagcactcgggcctyttcctttccacctaggggtccttctcttgtacctgaattcccccattcccttgaactcatacatcttcttccaggctggaagcagagtaagacaatgttg

SEQ ID NO: 345 - DNA, 201 bp, Homo sapiens
tagcaagggctccagggtctgtagtgagggctcccagagggcaagggtggggtctgttcaccagctctcctgtgccaagggcctgggctccagagctatayggcaggcaaagctgcaggccctttgtgatcattaacgtggtccctgggttgatggccagtggcctctggggccaaggtcaagccacagcagcccctctat

SEQ ID NO: 346 - DNA, 201 bp, Homo sapiens
aggccccgtgctggaaatctttccacttccaaagagcaaaagcaaacaggctgtgtgaccttcggtcagtcccctcccctctttgagcctcagtttctctrtctgcagattggggttggataatgagctctcagagggccctttggtttcaagagccattgaagatgctggaaggaagcaagctgaggccctggggaccct

SEQ ID NO: 347 - DNA, 201 bp, Homo sapiens
ggactttatctggggccatagtggagccatggtaggtctgggcagaggagtggcatggtctgggcttgctctaaggaggatgcattgtaggagggagaggwtgcaggaggatcagttaggaaggttctgcagtcatgcaggcaagaggtgatggggctatggacccagatgttggcattggggtggggagaaggggggaca

SEQ ID NO: 348 - DNA, 201 bp, Homo sapiens
tctggttccacaagtctggggtggggcctgaggctctgcatttctagtgatgctgatgtagctggtccagggatcacactttcagttgcaagatttgaaawcaatctgttattagtgtagaatcaatacttatgagataagggacttaagaggcaagtcccttgttcagggctaaagacccagtgacagtaatagggtcta

SEQ ID NO: 349 - DNA, 201 bp, Homo sapiens
taagggacttaagaggcaagtcccttgttcagggctaaagacccagtgacagtaatagggtctagcctggagcccagatcttttaatgtcttgtctttgayatctgacttatctgtctattttatctgcagctatgagtttctagaatctgaacagcccttaaaatactttgctgcttaattatgtagcaaagtaggttct

SEQ ID NO: 350 - DNA, 201 bp, Homo sapiens
tgtgatgtatgtaaggcaaggctgggagaggtagttccaactaactgccagcacctgctcctgagctcccaccaccagcgggcttgggtagtttgggtgtsgcccattcataaccccacacatcgcctgcagcgccatcatcttgacatagcattttccctgtgtgtctgcacattgtcttccctctgtatttgtctgttt

SEQ ID NO: 351 - DNA, 201 bp, Homo sapiens
acttctctttaggatgattttaacctttcttctccagaccaggctctggtctttggctttgcacaaccaaaagacctttagaaagatttttctctcctctraaagagcaattttctcccaaagatgaattcttctgctagcccttttagcaatgagcacacgtagcaatatgtttgtgtctccaccacgttttatttctaa

SEQ ID NO: 352 - DNA, 201 bp, Homo sapiens
tgtactcatttagtagatgagaagaatgagacattgaaaacatgcacagtggaggtgggaatgaaagccagctctccaactctccagtcctctttcctgtsactgcatcaggctgcagggtgaaggggaggtctgggatacaaagagaacttagaggtggagcagttggattctgtgcagtgctaggagggaggagagggg

SEQ ID NO: 353 - DNA, 201 bp, Homo sapiens
cgttaaaaggctactccagttattggatttctgtggtgattgttttttaaaggttagccttgaccaattctattacaagttttttttttttcccagcagcrtaagtgagcagaatcaagagaagagactgatatttatttcaaatagtaaaagtaaaaaatatcaattagtttcttcagaaaggttacttggaatttcttt

SEQ ID NO: 354 - DNA, 201 bp, Homo sapiens
agaagaaataatatatctaagatttgcctcaaaattatctgagggcagggaaaggaaaggtatgtgaacacgtagatgattcaggatgagtatttagtggmaattgtaaaagctgggtggtgggcacattaggatcattatactactctttctacatttgagtggttttaacattttccataataaaaaagtttttttttt

SEQ ID NO: 355 - DNA, 201 bp, Homo sapiens
gtggggtgggcaggggagaagccctggtgtctgggaaagaaggcgagtaggtgaggctggtgctagatcaaggaaggccttggaggctgtgctaagaggtytggaaggtgatgggggctgttgaagatttttaggcagggaaatgacagggttatgtttttaagaaagatcatttagaggccatcgtgtagtggatgatta

SEQ ID NO: 356 - DNA, 201 bp, Homo sapiens
tgttagttcatctctttattcatttcattcatccattcattcattcaacatttactagtctcctaatgtataccaagttctgtgttgggcactgggagcayaatagtgaacaagacttggtccctgcccatgagggattcactgatagagctagaaacataaacaggtaagtataccacagtgtgataagtgtcagtgcaa

SEQ ID NO: 357 - DNA, 201 bp, Homo sapiens
attcagcaaacaggcacgtagtgagagccccaggctgggattgtgagtgctggaatgaaacccttctctttatggctccatctggagtgtgtgggtggtgsactagaatcagtggttttgctgaccttgtttttaagctgctgcagccttaaggtccaaaatggaaaacagaccaacttggagttagctggggctaattct

SEQ ID NO: 358 - DNA, 201 bp, Homo sapiens
atattctgaaatatttatagaagaaataatatatctaagatttgcctcaaaattatctgagggcagggaaaggaaaggtatgtgaacacgtagatgattcrggatgagtatttagtggcaattgtaaaagctgggtggtgggcacattaggatcattatactactctttctacatttgagtggttttaacattttccataa

SEQ ID NO: 359 - DNA, 201 bp, Homo sapiens
ccaaaatagaataatcaaatcaccaaatcaaataatcaaattgacttagttgttacactgggatcctaatgaaccccaatgttagccctacttgactcacragattctggtaatgggtcactgataaagcccaggtaaagcaacctcacccccccaccccaccacccccagtgcccaccacaccccgccactgcaagggag

SEQ ID NO: 360 - DNA, 201 bp, Homo sapiens
gtacctagggggttcccatgatgacaccagccactgttgacagagccctttatatgcctgaggccttgacacagagaattcatttaatttccccataattmtttgagtggatattatcatcagaggaagaaaccaaggctcagagaggttgagtaactcagggtgtcctgtccttcaaggcctctgagtacaaaaatagca

SEQ ID NO: 361 - DNA, 201 bp, Homo sapiens
aaatgtgatatttttcacaatttgtctaccacctgccatcttccaacttgctctgccataatcactgccccagaaggtttcgtgcttttcgggtgcagggrcacgttttgactttcttggaccctgagcacttttgccttgtggcttgtacattacacacacacatatatttcacacacatgtaagttaaatatatgtata

SEQ ID NO: 362 - DNA, 201 bp, Homo sapiens
ttctggcctatgagataacaggggatgtaaggcatgtcatcttttccttaagaaagaggaaaattttcctatagaaaccctgcctgctcctgggcttctgsgtaaattttcctcatccttaaggaaagggtgatgtacctacatctctggcaggaacataaaacagcacaacccctatggagggtacattagtttcctatc

SEQ ID NO: 363 - DNA, 201 bp, Homo sapiens
agctctagctatcctcctgccgcggcatcccagcatactgagattacaggcatgagccactgcacccgaccctgtttgtttttttaagtaaatttttgaaytgaagtataacatacctacagctgatgtgttctttttttttttttgagatggattctcactcttcacccaggctgaagtgcagtggcatgatctcagttc

SEQ ID NO: 364 - DNA, 201 bp, Homo sapiens
tgcattgattacagccctgatctaccaatctacctctccgttgcctcttcctaaaaggattaaggatggctttcagaaatatatacaacaggataaattgwattgcccacatggctttattacttctcataggcatgcatcagccttaatactagaacttgttatttatgtgtctgtctcttacgtcagatgttctccctg

SEQ ID NO: 365 - DNA, 201 bp, Homo sapiens
ctaatccaaacattcttccaggaagacacaccaaggctcagagcaggaaaggactcattcaagctcacatgataacttggcagcagaaccaggcctggaaygcatatttcttcttggtgctgcattcctgattcagaagagcagctctccctgctaagcaaacagcaggtgggcggatgtggtcactaatcagtgcactgg

SEQ ID NO: 366 - DNA, 201 bp, Homo sapiens
agggagataaaaatggtgctgtgacacagaataatatccccttagagtgatgaaggaaagccttgctgagatgtgacattcaacctgaaagcaaaaggagwcaactctaccaacactggaaggaacagcaagtgcaagactttgaagttggaaagaaacagaaaggaaaccagaatgggtgaagcatattaagtgaaggag

SEQ ID NO: 367 - DNA, 201 bp, Homo sapiens
aatcaattaacaaataaatgggtaaataatcaagatatttacagattaagcaagtgctacgagggagataaaaatggtgctgtgacacagaataatatccycttagagtgatgaaggaaagccttgctgagatgtgacattcaacctgaaagcaaaaggagtcaactctaccaacactggaaggaacagcaagtgcaagac

SEQ ID NO: 368 - DNA, 201 bp, Homo sapiens
tttattgggtgtgtgcaatgtgtcaggtgcagtctggaatttggaactgtcacatactggcagcatgacctctttaagaggcaggaacttgttatctctgycatccggtcccatgttggggaactatctatgaatcagccaagatgggttcccagccctccatccatctcccttcaaggcaaaatggtctaatgggaaaag

SEQ ID NO: 369 - DNA, 201 bp, Homo sapiens
gtgggccttgttggagccaatgtgcagcctgacttttctcctaggcaaatgaggtgctctaaagggccccaactgatttctcactttattagtcagcacckagcacagtgtcaaatacacagaaatggctcaagaattgtctgtgagccaggcacggtggcttatgcctgtaatcatagcactttgggaggccgaggtggg

SEQ ID NO: 370 - DNA, 201 bp, Homo sapiens
aaatcctcataatggtaagaagaaaagaaaaaataaaaattatagctgtgacactctgtgtaacagaacattgactggcacttttcctatttgccccagarctgtagctaaggcccatgagacctggagccaaaggcttagggaaggaccacagaacagcaggggtcagagtgggccttgttggagccaatgtgcagcctg

SEQ ID NO: 371 - DNA, 201 bp, Homo sapiens
tttatttatcagatactaaccaaagtaagtgatctttctacttaaatgctactgtatgcttaaaactccagagaatctaattcattctttttctattataytttactaaaacaaataaaaatcaccccaagtccctactagttttctcaaatgctttctatacatacatacatacacacacacacacacacacacacacac

SEQ ID NO: 372 - DNA, 201 bp, Homo sapiens
ccagtgcaatcctgaaggtgcctaccatcaacgtcaatgactccgtcaccaagagcaaaatttgacaacctctatggctgccaggagtcccttatagatgrcaccaagtggaccaagacgtgatgattgccagcaaggtagcagtggtagcaggctatggtggtgtgggcaagggctgtgcccaggccttgcagggttttg

SEQ ID NO: 373 - DNA, 201 bp, Homo sapiens
tgacaacctctatggctgccaggagtcccttatagatggcaccaagtggaccaagacgtgatgattgccagcaaggtagcagtggtagcaggctatggtgrtgtgggcaagggctgtgcccaggccttgcagggttttggggcctgcataatcatcaccgagactgaccccatcagtgcactgcaggctgccatggaaggc

SEQ ID NO: 374 - DNA, 201 bp, Homo sapiens
ggaccaagacgtgatgattgccagcaaggtagcagtggtagcaggctatggtggtgtgggcaagggctgtgcccaggccttgcagggttttggggcctgcrtaatcatcaccgagactgaccccatcagtgcactgcaggctgccatggaaggctatgaggtgaccaccatggacgaggcctgtcaggagggcaacatctt

SEQ ID NO: 375 - DNA, 201 bp, Homo sapiens
actttcacaagcatggtcaaggaagccatctgggagaaggtacacattgagctgaggcctgaatgagaacgaggaggcaggctggggaagaccagggagasagaatggtaaatgcaaagtctcatagacagacacaagcttcgtatgtgtttgagagggagaaaaaagctggaatgggtagaatatagcaaatgagagaga

SEQ ID NO: 376 - DNA, 201 bp, Homo sapiens
cacactcataatgacagagccaggctttaatcgcatgcattttggcgctggaaactatgctccaaacaccgcaagaaactgcctcactgtgggacgtcacygcacatttaggggcggacaacaggtgcaggaggtataaggtgtaggaaggtaggaactgatgggaggtcacgtaaatgacatgaaagtattttgcaaact

SEQ ID NO: 377 - DNA, 201 bp, Homo sapiens
ggcttcataatctaaattacatagaccaaaaacaaatcaataggaaaaaagtgaaagtcacagagaaagacagattttgttctcagtgcaaactgttcaaygccatgcatgctgacactaacacatctttaaggactttttgttcatctagaaagacgtcttggaagaattaagctttgaggaagcactgaaggaggacaa

SEQ ID NO: 378 - DNA, 201 bp, Homo sapiens
gacagagtgtgaccctgtctcaaaaaaaagaaaaaaaaaaaacaatttccaaaattaaaaaggagtaggaaatatgatatcctccttgtagttaacaatgytactacttctcatctcttctttttgctcacatgtatcaagtaaaagcactagattattaaaaataaatgataaaaatctaataagatctgtgataatatg

SEQ ID NO: 379 - DNA, 201 bp, Homo sapiens; identical to SEQ ID NO: 364

SEQ ID NO: 380 - DNA, 201 bp, Homo sapiens
tcagtaaattagatgtttttaaatcctgacattaaatataacatataaagtaagagaataaaagtatataaaatattttgtaaatctatgaccctcatccycctttgtttaaaccagtatggtccttgagagtagcagccttttttttccccttgctaaaataaaataaacttcagttccaccctctgttgcttacctgtt

SEQ ID NO: 381 - DNA, 201 bp, Homo sapiens
tactgctgtaactggcaacatgacacaggataattctagcttgacctgggccattctggaaggataggaggtagcctttgcctcaagcatattgttactamcctgcaccttagaaccacctattagagagttgatctgtgacaatatgcaagtctttctgattaccaatgtgttaccagtctacagattatatgacggaag

SEQ ID NO: 382 - DNA, 201 bp, Homo sapiens
aaaggaaaacttttgctgtttttataactccctttcacctatagcatccagaactttattcatcaatgcaacttatacctattgataactgattttttttyccctctaaaatgaaaagttagagaaaggccttacttatagagcagctgcctgtagatgtcactgctgaacaagggcagcgaagacattctttagtggcat

SEQ ID NO: 383 - DNA, 201 bp, Homo sapiens
accatctttacactggtcacattcaggttccaattcactcgattctaaaagagagaatgccaaaatagtttagtacagtctgaagctacaattaaaaatgsaaaacaactactagtccttaaaaagatttataatcccagaactttggaggccaaggtggaaggatcgcttgagcccaggagtttgagaccagcctgggca

SEQ ID NO: 384 - DNA, 201 bp, Homo sapiens
agagttggttaaactacagctttttacaattttctggcagaagggaccttcttttaatccagaattggaataattcaacaagtttcctgaagtcataaaamaggtagaagaaagagagaagtctagtctagattatagaaaaatatttactatacaggatcatgtactcaaatactttactcattagcattctaaacaccc

SEQ ID NO: 385 - DNA, 201 bp, Homo sapiens
taatctatccaacaaagaacttcacccattttcacaagcctaggattggatccacaaaaattacatcattcctgatttctgaattgaaaaggaaaaatatygtcaaaatcaagagtaggaatacacaattcaaacctcttcatgtacatcgaatgagtctttaaaaaaaccaacaaactggctgggtgtggtggctcacac

SEQ ID NO: 386 - DNA, 201 bp, Homo sapiens
atttatgataagtgatattaataatcaccaaaacctggaaatcacccaaatgtccttcaactagtgaatggatacactatggtacattctcataatggaayaccattcatcaataaaaaggaataaaccactgacatccaagaacatggatgaatcttaaatgcattatgctaaatgaaaggagccaggggaagagaacag

SEQ ID NO: 387 - DNA, 201 bp, Homo sapiens
tttatcgcctggcttctgaagaacaataaaatatagtgattttcaccctgaagaagaataagaaactaaaatctttgccaaactgctttaagtatttgaaratagtcacataaagtcccagagaaaatcaaatcctgcactttttcaaacattccaaaagccaagagatgaaaattttttagccctaaaaaaaagattttg

SEQ ID NO: 388 - DNA, 201 bp, Homo sapiens
ttgaacacgggaggcggaggttgtagtggcaaaaaagcctcaaatcaatgtgcaattgtctacatataaaggcatccctgataacattttaagaactataytgagattcacgcattcactaagcatactgctttttgagataaaatgctacctgatttctctattcatttattaagcacatgtcaaaatataaatcaggaa

SEQ ID NO: 389 - DNA, 201 bp, Homo sapiens
aagcagttacctacttttgatcaagatggctacctttaaaaagtctactttcacggaaaaaaatattcaagtgtaccataaaggcaatttaaactagagaytggtataattgcaggaataattggggtacagagtaaagttatcttaaaataaaaaaaagtgaagtattgttctgctttcctacaaaatagcataagaata

SEQ ID NO: 390 - DNA, 201 bp, Homo sapiens; identical to SEQ ID NO: 369

SEQ ID NO: 391 - DNA, 201 bp, Homo sapiens; identical to SEQ ID NO: 370

SEQ ID NO: 392 - DNA, 201 bp, Homo sapiens
ttgaactcaataaatatgtatggaatgagcatggttccaatgacacattttagcacaagttgtttgcagttaatatgaccattgataagcatttctttgartcatagtttcttcacatgtagaaactgggtaataatctgtatcctaccctatccaaacaattccaggagtatttatgttgccagttttcatcctcagttg

SEQ ID NO: 393 - DNA, 201 bp, Homo sapiens
cagacatttaaaaagaaatataaatattttattgaactcaataaatatgtatggaatgagcatggttccaatgacacattttagcacaagttgtttgcagytaatatgaccattgataagcatttctttgagtcatagtttcttcacatgtagaaactgggtaataatctgtatcctaccctatccaaacaattccaggag

SEQ ID NO: 394 - DNA, 201 bp, Homo sapiens
taaaataaaatccaggtataaatacaaataaaaatgtacaaggaacctataagatagttacaacctttaccatagagggtataaaataagaaaatagaggyacagagaaattaattttcccaaggtcagatggtcatgaccatctttaagagcagtgtgaagaaaggactagagaaggtagactagggctacaggtttatt

SEQ ID NO: 395 - DNA, 201 bp, Homo sapiens
ccaagatgcaagacaaagtccgctttactctttgcatcctctccttaaacaaaaggaaggagtcacttttgttgctgcgagatgcactgcctggggttggsggagggatggcacaagacaagtttacttatatgtgcatttctttttataataaaaatgggttatgtgcctaatgaaaaaaaaaaagaatgcatttgactc

SEQ ID NO: 396 - DNA, 201 bp, Homo sapiens
acaatttatactcccatcagcaacggaataatggtctcactgttctatattctcgccaatacttgacgctatcagcttttacatttttgccaatctggcascttgaagtagcatcacaacatggttttaaattgcattcttctgattagtaatgagatggaacatcttttcacccttactggccatttgagtttcctcttt

SEQ ID NO: 397 - DNA, 201 bp, Homo sapiens
gggtagagtagtcagtaggcaatatttgggcatgatcaattttactgggcaatgcctattttccaacagggtggtaacaatttatactcccatcagcaacrgaataatggtctcactgttctatattctcgccaatacttgacgctatcagcttttacatttttgccaatctggcaccttgaagtagcatcacaacatggt

SEQ ID NO: 398 - DNA, 201 bp, Homo sapiens
caattataccaacctttgtagtatattaaaaattgcatacacaatgcatttagcacagtgtctggcacatactcagtactcaaaaatgaaagcaactatgracatgatgacagtgatcctagatcttaaatattttctgagaattctaaggaaagtaggttagaattcccagttggcaaagacagggaagactaagttact

SEQ ID NO: 399 - DNA, 201 bp, Homo sapiens
aaagaaaaaaaaaaggctgtgaacagaccacttatgcttatccatagatttgaaatgaaagaaccaaaacccacagcttcataactggagaataaatgtgkagaactggattttaaatagaaatcagacatctgtactatgagatcagctaacaatttaagataaaatttgcttatctggtcttaatgacatgttgctagt

SEQ ID NO: 400 - DNA, 201 bp, Homo sapiens
atcactttcctctctttttagatctccaattacatttatgctaaaccttttggctgtgtcccacatcttccctgctctgttctttccattatattttctcyaaatgcttcagtttggatatttttaattgtactgtattcaagtcttctaactttgtcttcactgtgtacaatctactgttagattaatgcaatgagttat

SEQ ID NO: 401 - DNA, 201 bp, Homo sapiens
gagccgagatcgtgccatgtactccagcctggtgacagagcaagactcggtctcaaaaaaaaaaaaaagatttttagtacttctctttgtaatctttcctyatttacaggggtttggcttttgttttttaactagtctaattatatggcataagttattttataccttgcttctttcactttctcatattgctatatatca

SEQ ID NO: 402 - DNA, 201 bp, Homo sapiens
attaaaatttaaaaaccacactaagcgcactaagcaaatggatacagagtacactaaccagatggatataaacatgaggtaaaaattaaaatgtggattgygagggtataggggaattttacactctgcttgtctctgtggagggaggggggtaaaacaggactacggaggaaaagaggacctcaactttattgaaatttt

SEQ ID NO: 403 - DNA, 201 bp, Homo sapiens
agctactttataatttaggtattatactttgtatttctaatggcagcatagtttggtggaaggactaaaggctttggaatcaaatagaagtgtgtggctasagataagtaaatttttttaaagctcggtttccttatctgtaaaatgtgaataataacatcaactttgctgagttcttgggaaggattaaatgaaataata

SEQ ID NO: 404 - DNA, 201 bp, Homo sapiens
gtgcttatgcctagcattacaacttgactttaaatcatttagcttttggactaacttagatctgaagccctgggcttactttctagggctgctgctgcagyaacaagtaacaattcctacccacatagcccaaaatataggaaccagggatgttcattataagtggtgttatgttcaccaagcatcctaaaaagtgtagga

SEQ ID NO: 405 - DNA, 201 bp, Homo sapiens
ataaatcttaaccagaattaattatcttactctgaacacccttatcttcccactgaatagaatacaagaattaaaaaggtcctcacagagaacatttaackaaacttcttggatttaccagtggaaaaactgagatccagatggattcagcggcctgcccaagttcactctacaagtgcataacagagcaagaatagaccc

SEQ ID NO: 406 - DNA, 201 bp, Homo sapiens
tgaagttctaatggataaactttcaatactaaccaagttcactggttatttattatttctatagtcagtctaatatcttcattattccctgaacatactcyggttagtcctgtctctgaacctttgcttattctgtacatcttggaatgctctttttcacatattcaaacctattctctattttaagaatcagctgaaact

SEQ ID NO: 407 - DNA, 201 bp, Homo sapiens
taaaggctccctgtgacctgaccccaacaggacttaccagactcatctcctgtccccactcctcttccacttgacatcttcagtaagcccatctctgagaygttaatcttgctgtttgctgtctgtaaagtcctttctcatcttttttcacttctgtatgtctaaatcctttccttccttcaaagctgggatcaaaagcta

SEQ ID NO: 408 - DNA, 201 bp, Homo sapiens
ttgtagcccaggtctgatttctagatttatatttccataggccagtacctaaactgatgagtcatactcacccacagctagccttgcacttacattgagaygctcacactgccatatctaattttgcctattctatttcagggtacagtgggaagagacttggagccggacagatctgggctcaaatctaagttctgccat

SEQ ID NO: 409 - DNA, 201 bp, Homo sapiens
agtctacatctctgtcctaaattccaaactatatactaacttcctgtacacctggatccacaaacatctcaaacttaacatgtacaacactgtcctcagtrtcttcccttcctgagtcctgtcttcctccaatgttccctagatctcagtgaatggtaccaacatctacccacttgcataagccaaaacactgagaatcat

SEQ ID NO: 410 - DNA, 201 bp, Homo sapiens
taaaatattgttttaacaaaaacttcctccatccctcccaaacttaaatgtgggtactctgcagacttctattcttggtttctttctcttctctgctcatyttccatgggtggcctcatccactgacatcatcaacaattccaatatgtgtatgtgtatctctagtctacatctctgtcctaaattccaaactatatacta

SEQ ID NO: 411 - DNA, 201 bp, Homo sapiens; identical to SEQ ID NO: 371

SEQ ID NO: 412 - DNA, 201 bp, Homo sapiens; identical to SEQ ID NO: 372

SEQ ID NO: 413 - DNA, 201 bp, Homo sapiens; identical to SEQ ID NO: 373

SEQ ID NO: 414 - DNA, 201 bp, Homo sapiens; identical to SEQ ID NO: 374

SEQ ID NO: 415 - DNA, 201 bp, Homo sapiens
tgaaccacttgcaatcagtgaagacgtctttttctttatacaaatttctactcactcttcaatatcaatccaaatgcaactgcctctcttaagatctcccygaatgtttgcaagtctatctttgcaagtccactagccagtaagttccttgagaatagaggtaatatcttttgacatatggttggcaaatgcaatgtcttt

SEQ ID NO: 416 - DNA, 201 bp, Homo sapiens
agagataaaaaaaaaaaaaaagaacaccaggaggctatgatcatatttaatattttatctcaaaaatgaaaacaatccaaagcaaatacaggagaaaattsagatattacaaagctgggaggcaggtatacaggggatgttcactatattactttttatacttttcagaaaacttatttcatattttttaaaatgaagaat

SEQ ID NO: 417 - DNA, 201 bp, Homo sapiens
aattgcatcaataaacaaaacggcatgaaatttcaagggtttctcagaacctctgaagcctatgtaaaattgacacctctcttgaataagaaatattatcstatccactgaatagaagttttgttgccatacttcaacaaataagttcacataccaactcttgtattgtcaactaccttttgtacataaaccatcacttac

SEQ ID NO: 418 - DNA, 201 bp, Homo sapiens
cagccaggcatggtggctcatgcctataatcccagcactttgggaggccaacgcaggaggatcgcttgagcccaggagttcaagaccagcctgggtatacrgtgcgactctgtctcaaaataaaataaaataatgaataaaataaaggttaaagtgaactgcctaaagttacatgattacctaaaaatacccaccatgatt

SEQ ID NO: 419 - DNA, 201 bp, Homo sapiens
gagacagagtgagactctatctcaaaaaaaaaaaagataatgccaaagagattcttacactaggaaagaagtaaatatttcaatacgaagaaatgaaattsaggttgggcgcggtggctcacacctgtaatcccagcactttgggaggccaaggcgggcggatcacttgaggtcagaagttcaagaccaacctggccaaca

SEQ ID NO: 420 - DNA, 201 bp, Homo sapiens
acctgcccatcctccctcctggggtatgaattctcaaggggatgactcatgtcctaagtaccttcctaagtcaatatacaaccagatttgatcatcatcamaggtgggcttggggttcatggtcaagggcagatgccaggagtaagagatggaaggacagaaggaagaaatgaaggcagcagaggagagaagacctgggga

SEQ ID NO: 421 - DNA, 201 bp, Homo sapiens
aaacctacatggccgaaatagccccaaacaacaaattgcgtagagacacagtgcacagaaatacatggtacaatcgcaaatatataccacacgcacaacaygtcatgtaaataaagggcacacaatgaaagacaacatgcacagagtcataggaatggcagatggagtcagtgggcagagctccaatcatagggaccctgc

SEQ ID NO: 422 - DNA, 201 bp, Homo sapiens
ctcacctctgaggctacaggccagctccacccattactggccatgggagcctgagtgtgtcacttctttctttcttttttttttaaacaattcttgctccmgagactttaagtcttaagcctccgtgtcctcacctaaatagagttattgggaaggttagagttaatgtatgcaaagcccctggtgcccagtaggtgtgca

SEQ ID NO: 423 - DNA, 201 bp, Homo sapiens
gatgggcacggagtcgagtctgtcaatataggggggtggggggtgaggatgtcgcacagttgggaccctcaaatacctatggagatatgaactggtaaaaygattttggagaacagtttggcaacttgtaagaaagtggaagatactcatagctacaattcaatgactccactcgtcattcagcgcataattgtgaaaatt

SEQ ID NO: 424 - DNA, 201 bp, Homo sapiens
cagagatgtatgccatgccacttttgtcaggtccccagcagtcctcttgagttttttaattgccaaaatttattttaaaatccttctgtttgagtgttccrtgacatgtgaccttcttatgagtttcagaggtaatccctgcctgggtggaggaatacctaagtgaccttcaggacctctttcagcttggagaagcggaaa

SEQ ID NO: 425 - DNA, 201 bp, Homo sapiens
gatggagaccaagggccttgtatcagttggaattcttgattatgagcaaccaggaccaactctgtccatccaaagcaaaagggggactttctggagggtastgaaggtacacagaatgaacaagaggctggagaacaggcttggacaaagggcaggaccaagagaggaattctggccaagggaaggctgcaggcacagtct

SEQ ID NO: 426 - DNA, 201 bp, Homo sapiens
gcaggaggactcgctcctaattccttcctggttccgagtcaaaggatgaggccctgaatctgttaaagagaaaccacagctttcagataacagacaaacaygtctttaacacacgcaatctttgattcaaatgatttcaaagggcatgggggagggaagggtttttgtgagctttaaccgaagccgctcatcagaatgtca

SEQ ID NO: 427 - DNA, 201 bp, Homo sapiens
gacaatagccctgccatttcctagcgactgggaccttagccaagctgactaacctctcttagcctcagtttcctcgtctgtacaatggggacaatctcagygccaccttatcagagttgctgggaggattgagtaagatgatgtaaagtgcctagcatgtaacaggcacttaataagtggcagctgtgattatttcaacac

SEQ ID NO: 428 - DNA, 201 bp, Homo sapiens
aaactgaggctcagggagtctacaaatcctggccaaggacagtggcagaggcgctatctgtctccaaagcccaggtgtggcccttctgcttggagctcagrctctgtgatgggagtctctggtctgccccactggaggaggcaggagaggcagggactggggaggatggaaggctcacccgcacagccagtgcgaagatgc

SEQ ID NO: 429 - DNA, 201 bp, Homo sapiens
tgtgctatcttcccaggtggtgcagacaccccctccctccttttccctctccaggcccacagcctccccagagcccaggtagggaaggtccagatgtactrtaacaggattgctcatcccaggctatctcagaagtctggaaagcaggcctagaaggttgctgggctctctgaagccaggcaggaagctacaaattggatc

SEQ ID NO: 430 - DNA, 201 bp, Homo sapiens
cactgcactccagcctgggtgacagagcaagactctatcttggaaaaaaaaaaaaaaaaacaaagcaggagaggtctggccaaagtcctgcaggaaagackcattcaagatgaagtagtaaatcagcacatgagccataagtgggtccaggcctctgcccctcccttgcccagagatgtatgccatgccacttttgtcagg

SEQ ID NO: 431 - DNA, 201 bp, Homo sapiens
cacaaaatctcccaatcctggagagcacattttcaagtcccaaaggggccctaggattgtgctacttaaccatgttctgccaagagaaggtgtgtccaacrcgggtagggctgatgatgggagcagaacactcccactagcttctaagctggctgggtctgccttcaggatgctgggggacagagatgatagagcgaagtg

SEQ ID NO: 432 - DNA, 201 bp, Homo sapiens
ccactagccaggcaggataagatgccatggaaggatttagctccactaggatttcacagtgatggtggccttgggaggtgggtgctagttttatccttccycaaaatggggagctcctccaaaaaggaaccagaattttaaggtgggggtggatgctggacagatcataagtgacagctaaacctcttggagctattgccc

SEQ ID NO: 433 - DNA, 201 bp, Homo sapiens
gctgcattgactatttgcgagatattttgtcttcttgttttttatcaattaggtctacatactacattcaattagagattttgattgatatgattaaaacwgtgtgatcataaaagactgactcagatatagttaattaaagatacctttaaagttttccccacgttaaaatacagaggtgtcattttattaatgaactcc

SEQ ID NO: 434 - DNA, 201 bp, Homo sapiens
tatttcttagaaaaaaaaattaaaatctgaggcaagtatgaccaagtgtcaagatgtaacagagctgggtggttgatccatagttgttctctctgatcctyctccttctcaagtctaaaacttttccatgtttgagatatttggtgattttaaaggtgggaggggcaggaagctatgaggagattgcagcagaggaggttt

SEQ ID NO: 435 - DNA, 201 bp, Homo sapiens; identical to SEQ ID NO: 77

SEQ ID NO: 436 - DNA, 201 bp, Homo sapiens
cacttcccgcagatgaggatctcattcagcggccctgatgtcttccctaggcagatgttgcacttgggctcctctcctggaacaccggctgaaagagaggscctcgagggtcgggtccagctcacaggaatggaagttttatactcacattccagatgcccagcctctaatgtctgctaggcctagcgctgggccccacat

SEQ ID NO: 437 - DNA, 201 bp, Homo sapiens
tttctcatttccttccctctctcccttacaccctcaaaagagagagacataatatacattctcaaggtcatataagctatataatgaaagctacctttttytccccagtgatgttatttcctcagtggctcacaccatctgtagtcatagttcccaaatttggccatgcggtctatccctgaactccagcctcaatctatt

SEQ ID NO: 438 - DNA, 201 bp, Homo sapiens
aaaattgcttttagtctacaggtcccctctccatctctttttttctttgcattttattttggttgaagaataaatatgtttttatgtgtgaaaggtttgtrtgtatacattaaacacattttgatacgtgtttgtcttatttccccagcatgctgaaaattttgtaagggtagaaatgggatctcttcggccgggcgcagt

SEQ ID NO: 439 - DNA, 201 bp, Homo sapiens
cccaattttggtttccctccagatgaggcagaatttgaatgttggttccaaaaattctctttcaaacccccactggcaagggcttccctttgagggaaccraatgatgcaggctctttaaaaatttcaacctatcccaaaaagtgattgtccatttcagggcagggcaagggatatgaaagagggtgagtcccctgtgctt

SEQ ID NO: 440 - DNA, 201 bp, Homo sapiens
gtccctccacatgctctccactacagccacacacagcctctctctttccccgcgggcctactcgggtctcctccttgtggccatggcgctgggcacctggygttgtgactatctgttcacagggagagagtccagtgcctgtttctgtgtggtgcgtgtgtgtactcctgtgagactgggcaggatgatgtctacggcatt

SEQ ID NO: 441 - DNA, 201 bp, Homo sapiens
tacacaccagccataggcatagatacacaagggggaacacactgtacacaacagagacacacaacagaacatgcatgtaaggtagacggacataacacatraagtcacaacacagacgggcaagagacacaagttttcctgaaaaagtggcattcagataggttgtggaaataggttagtgggtgtgccaggtggagggaa

SEQ ID NO: 442 - DNA, 201 bp, Homo sapiens
acaaggtcatggttaacaagactgccacccataaaatagtttctacaatgtagttaacccaccagcaaatgaacttacatattgaacccctgtcaaagatkaagatatccctgaacagggccaagtcataccaacctgttttctgtaaaacctgttttccttcaacattggatcccaagattccaactgtgtctacagcta

SEQ ID NO: 443 - DNA, 201 bp, Homo sapiens
caactctatagccctatgggctttttgaataaccaaatgctcaacagttctgtaatctttcaggttgctgtgatcagtccccaaggagtctacactctcamagagactgggaaaggcctgtgagacaatgggattcttttttctagaggtgtaactctgcctgtgtttgcatgccacctccagaaccactaaaatataatt

SEQ ID NO: 444 - DNA, 201 bp, Homo sapiens
ctcactgctggttttgtgtgtgtgtgtgtgtgatttaaaattacattcagtcaactctatagccctatgggctttttgaataaccaaatgctcaacagttytgtaatctttcaggttgctgtgatcagtccccaaggagtctacactctcaaagagactgggaaaggcctgtgagacaatgggattcttttttctagaggt

SEQ ID NO: 445 - DNA, 201 bp, Homo sapiens
ggaggtcgaggcttcagtgagcggtgattgtgccactgcactccagcctgggcgacagagcaagaccctgctttcccctcttgtcctccactaccctcagraaaccaagaaagaccagcgtggagagttggtcgcccatctgctctaagctgctgtgtattcccctgtaatgtaaacatcgtgaaggtggagacccagtta

SEQ ID NO: 446 - DNA, 201 bp, Homo sapiens; identical to SEQ ID NO: 77

SEQ ID NO: 447 - DNA, 201 bp, Homo sapiens
aggacctatggaagtgaatacctaccgtaaacacttttaaggcagcacagtgtagttcagggaagggctgactactaatgccacggaagagctccagtggrtcccgagataaagaagaaaaccaggattctgtcatcctcagaaggtcatcagtctgctgctcaggctacaggaaagaaaaggaaaatctcatcaaaagtt

SEQ ID NO: 448 - DNA, 201 bp, Homo sapiens
tgcattgagactatacagaatcatggttaagaacacagactgtgtagtcagactgcttcgattcaaagcccagctctgcccagctgtgtaaccttgggcarttttcttaacctctctgtgcagtcattgcctcgactgtgaaatggggtaaaaataatatgtggctcatagggttcttaacggagttcaatgagttaaaat

SEQ ID NO: 449 - DNA, 201 bp, Homo sapiens
aaatgcaacatatgagaaccaacattgtttaactcaaccttgtcaatctgggcaaagtgtgctgaagacaaggagttagtccttgacgagtgagtaagagkttaagaagcaaagttaaggaagagtgttagatacggagaccccagcaaaggtccagagacacaaaacaaacagtttggtaccactggagcattaggtgcc

SEQ ID NO: 450 - DNA, 201 bp, Homo sapiens; identical to SEQ ID NO: 437

SEQ ID NO: 451 - DNA, 201 bp, Homo sapiens
aatcaaaaataaaagttgtcctactattttcagacccacttccctattaatagtttctggtgtacctttgcagatatttgcaatgttatacaagttttacmtgcctgtgggggttgggaagattgtaatcctttttaaaaattacaggttaaaattatagattgatataccctgcgattttctttttcattcaacaacaca

SEQ ID NO: 452 - DNA, 201 bp, Homo sapiens; identical to SEQ ID NO: 289

SEQ ID NO: 453 - DNA, 201 bp, Homo sapiens; identical to SEQ ID NO: 295

SEQ ID NO: 454 - DNA, 201 bp, Homo sapiens
aacaatattcttagcacacatcaccatacttaaattttattgagtttttaattatgtgaagtcttcagaaatgcattccttataaaatcagacagttctgygtaggcggccaggtttattaacagtcttcccataatactcttgatcatatcacagattgcctggctataatgaagggcattaaggcttgtttccctttga

SEQ ID NO: 455 - DNA, 201 bp, Homo sapiens; identical to SEQ ID NO: 207

SEQ ID NO: 456 - DNA, 201 bp, Homo sapiens; identical to SEQ ID NO: 220

SEQ ID NO: 457 - DNA, 201 bp, Homo sapiens; identical to SEQ ID NO: 221

SEQ ID NO: 458 - DNA, 201 bp, Homo sapiens; identical to SEQ ID NO: 228

SEQ ID NO: 459 - DNA, 201 bp, Homo sapiens; identical to SEQ ID NO: 306

SEQ ID NO: 460 - DNA, 201 bp, Homo sapiens
ttaggcactataattataattagtcaatatctttattctaaggcagcatttcccaaagtgtgttcctcaataaaataagcttaggaaacaccaaattaaayaaagtcatacagcaaagaatttcttactgcagaacttcccagagtcttaatatgctaacgcacattatgacacatcaagaggaaaccttttaaggcattt

SEQ ID NO: 461 - DNA, 201 bp, Homo sapiens; identical to SEQ ID NO: 235

SEQ ID NO: 462 - DNA, 201 bp, Homo sapiens; identical to SEQ ID NO: 236

SEQ ID NO: 463 - DNA, 201 bp, Homo sapiens
ctcaaatcattcaactgaagctgcttttcagaactgtattcttctattagcttcacccaataactaactccctaaatttttcttcagtcataaaaactttyggaaaatatcaatgtgttatatcaagttttacatggcaacttaagaaaccataaaaaacaagtaagttcattcacagtcatacaattacaaactaaaaaa

SEQ ID NO: 464 - DNA, 201 bp, Homo sapiens
aagatgtaagagtagttgtatggtgcagttgccatggtggcactaaaaacaaagaaatctctgttacttcagaaggaaagcatatacaagtaattcaaacrgatgactgatatcctttaaaggtagaaaaggacactgaatacaaacaaatgttggttacagtaagtcaaaataaaactgcatttcacaaactgatcaaat

SEQ ID NO: 465 - DNA, 201 bp, Homo sapiens
aagaaagagtagaaagaattccattttaagtatttcaaatctgttatttaacaaatgatacatgcagcaaatttctcctaataagacaatcaattcctgtracagaaagtcagagaataaaaagattaagtttgacattattttatgtatttttaaaaattattttaacatcaagaaatcaaaacaagcaaatcagattat

SEQ ID NO: 466 - DNA, 201 bp, Homo sapiens; identical to SEQ ID NO: 246

SEQ ID NO: 467 - DNA, 201 bp, Homo sapiens; identical to SEQ ID NO: 251

SEQ ID NO: 468 - DNA, 201 bp, Homo sapiens; identical to SEQ ID NO: 328

SEQ ID NO: 469 - DNA, 201 bp, Homo sapiens; identical to SEQ ID NO: 330

SEQ ID NO: 470 - DNA, 201 bp, Homo sapiens; identical to SEQ ID NO: 331

SEQ ID NO: 471 - DNA, 201 bp, Homo sapiens
ttaattatgtgaagtcttcagaaatgcattccttataaaatcagacagttctgcgtaggcggccaggtttattaacagtcttcccataatactcttgatcrtatcacagattgcctggctataatgaagggcattaaggcttgtttccctttgaggccacccaattctagaatttactgaaaactttaggcactataatta

SEQ ID NO: 472 - DNA, 201 bp, Homo sapiens; identical to SEQ ID NO: 257

SEQ ID NO: 473 - DNA, 201 bp, Homo sapiens; identical to SEQ ID NO: 258

SEQ ID NO: 474 - DNA, 201 bp, Homo sapiens; identical to SEQ ID NO: 259

SEQ ID NO: 475 - DNA, 201 bp, Homo sapiens; identical to SEQ ID NO: 337

SEQ ID NO: 476 - DNA, 201 bp, Homo sapiens; identical to SEQ ID NO: 338

SEQ ID NO: 477 - DNA, 201 bp, Homo sapiens; identical to SEQ ID NO: 265

SEQ ID NO: 478 - DNA, 201 bp, Homo sapiens
ttacacaagccagacatttaatatgactggagaaatttatttactgaaattatcaccttactatataccatatttcaagcaaaagttctatataacaacaytgaacccgtagaaagaatatatatttaaaacaagtgtattattataagggaagaggaagttgttaattacagtaaagtattaatcacttccacacactac

SEQ ID NO: 479 - DNA, 201 bp, Homo sapiens; identical to SEQ ID NO: 277

SEQ ID NO: 480 - DNA, 201 bp, Homo sapiens; identical to SEQ ID NO: 278

SEQ ID NO: 481 - DNA, 201 bp, Homo sapiens; identical to SEQ ID NO: 279

SEQ ID NO: 482 - DNA, 201 bp, Homo sapiens; identical to SEQ ID NO: 282

SEQ ID NO: 483 - DNA, 201 bp, Homo sapiens; identical to SEQ ID NO: 361

SEQ ID NO: 484 - DNA, 201 bp, Homo sapiens; identical to SEQ ID NO: 92

SEQ ID NO: 485 - DNA, 201 bp, Homo sapiens; identical to SEQ ID NO: 420

SEQ ID NO: 486 - DNA, 201 bp, Homo sapiens; identical to SEQ ID NO: 95

SEQ ID NO: 487 - DNA, 201 bp, Homo sapiens; identical to SEQ ID NO: 96

SEQ ID NO: 488 - DNA, 201 bp, Homo sapiens; identical to SEQ ID NO: 97

SEQ ID NO: 489 - DNA, 201 bp, Homo sapiens; identical to SEQ ID NO: 98

SEQ ID NO: 490 - DNA, 201 bp, Homo sapiens; identical to SEQ ID NO: 421

SEQ ID NO: 491 - DNA, 201 bp, Homo sapiens; identical to SEQ ID NO: 422

SEQ ID NO: 492 - DNA, 201 bp, Homo sapiens; identical to SEQ ID NO: 423

SEQ ID NO: 493 - DNA, 201 bp, Homo sapiens; identical to SEQ ID NO: 101

SEQ ID NO: 494 - DNA, 201 bp, Homo sapiens; identical to SEQ ID NO: 424

SEQ ID NO: 495 - DNA, 201 bp, Homo sapiens; identical to SEQ ID NO: 425

SEQ ID NO: 496 - DNA, 201 bp, Homo sapiens; identical to SEQ ID NO: 426

SEQ ID NO: 497 - DNA, 201 bp, Homo sapiens; identical to SEQ ID NO: 427

SEQ ID NO: 498 - DNA, 201 bp, Homo sapiens
caagtagcacgtcgggatttgaatccgggttaaaggactccacgtccagtgctctttctatccaaactccagagggaggggaccctgctgacaccttaatstaccctggcctccctggaggcttttctcattggaatcccagagttactaagacttataaaggatagaactgtccccttaatcccgggcatgggggctaat

SEQ ID NO: 499 - DNA, 201 bp, Homo sapiens
cccacagcccacccctgtgaagtgttaggcctttgggaagaaggcccaggctagatgacttgctttcaagccccagcgctgccacctcctagcttgtagakacctcctcgccttggtcttgtcatctgcaaatatgcggattacgatcatatgtacttgccagggatattgggagcttgctcacaggctctcagaagcccc

SEQ ID NO: 500 - DNA, 201 bp, Homo sapiens
agagtgagaccccgtctcaaaaaaaaaaaaaaaaaaaaagaaatattaaattctctttctgatactaagtctttgaaatctggtgtatatttcagacagarcatctcaatttggatcagccacatttcacgtgttgtgtgagtttcaaacaatctctctaagattgtttgttttgagacgaagtcttgctctgtctcccag

SEQ ID NO: 501 - DNA, 201 bp, Homo sapiens
gcctcccaaagtgctgggattacaggcgtgagccaccgcacccggccttgacttcattttcttagtttctgtgtctttgcctggaagaaggggctaatggyagaatgtgataacaggatgttaagtgaaaagggagagcccaaaacagtaatcaatatgattctaattacatttttaaaagtcaatctacatgtatgtgtt

SEQ ID NO: 502 - DNA, 201 bp, Homo sapiens
cctaacgatttgagcaatggagtctggcacaggctcagcaggtggaggaagagtaagctgtcaggaaagcagcaggggagagtagtagggtcctgacttgwctcagggtctttggaaagttgggtgtggcctccaaggtgagaagataggtgtgggccaccaccaggccatgacaggcgggcagtattgcccaggcttctc

SEQ ID NO: 503 - DNA, 201 bp, Homo sapiens
cctcctggggcaaggcagaagggccagaacagagaggtcttctactgaggggctgtcatcgatgtcctgagacatttgtggagcttctggtatacacagcrcagacggaggttcccctgagaagccgattgtctaaaagtgacacaaaccctcttccctggcacatgcccctgaaatgtccatcaggaagctgaatggctt

SEQ ID NO: 504 - DNA, 201 bp, Homo sapiens; identical to SEQ ID NO: 102

SEQ ID NO: 505 - DNA, 201 bp, Homo sapiens; identical to SEQ ID NO: 103

SEQ ID NO: 506 - DNA, 201 bp, Homo sapiens; identical to SEQ ID NO: 104

SEQ ID NO: 507 - DNA, 201 bp, Homo sapiens; identical to SEQ ID NO: 105

SEQ ID NO: 508 - DNA, 201 bp, Homo sapiens; identical to SEQ ID NO: 106

SEQ ID NO: 509 - DNA, 201 bp, Homo sapiens; identical to SEQ ID NO: 107

SEQ ID NO: 510 - DNA, 201 bp, Homo sapiens; identical to SEQ ID NO: 108

SEQ ID NO: 511 - DNA, 201 bp, Homo sapiens; identical to SEQ ID NO: 109

SEQ ID NO: 512 - DNA, 201 bp, Homo sapiens; identical to SEQ ID NO: 110

SEQ ID NO: 513 - DNA, 201 bp, Homo sapiens; identical to SEQ ID NO: 111

SEQ ID NO: 514 - DNA, 201 bp, Homo sapiens; identical to SEQ ID NO: 112

SEQ ID NO: 515 - DNA, 201 bp, Homo sapiens; identical to SEQ ID NO: 123

SEQ ID NO: 516 - DNA, 201 bp, Homo sapiens; identical to SEQ ID NO: 428

SEQ ID NO: 517 - DNA, 201 bp, Homo sapiens
gcccctgaaatgtccatcaggaagctgaatggcttcccgttgccaactgaagcatcctcaccctgcacattaggaccccctgcggagacttcatcctgatkctcaggccttatcacttacgggggtgagattctgtcactggtgttttaaaaatctccccagcacctttgggaactgccgggggtaggagaacctactgac

SEQ ID NO: 518 - DNA, 201 bp, Homo sapiens; identical to SEQ ID NO: 430

SEQ ID NO: 519 - DNA, 201 bp, Homo sapiens; identical to SEQ ID NO: 126

SEQ ID NO: 520 - DNA, 201 bp, Homo sapiens; identical to SEQ ID NO: 127

SEQ ID NO: 521 - DNA, 201 bp, Homo sapiens; identical to SEQ ID NO: 431

SEQ ID NO: 522 - DNA, 201 bp, Homo sapiens; identical to SEQ ID NO: 432

SEQ ID NO: 523 - DNA, 201 bp, Homo sapiens; identical to SEQ ID NO: 129

SEQ ID NO: 524 - DNA, 201 bp, Homo sapiens; identical to SEQ ID NO: 130

SEQ ID NO: 525 - DNA, 201 bp, Homo sapiens; identical to SEQ ID NO: 132

SEQ ID NO: 526 - DNA, 201 bp, Homo sapiens; identical to SEQ ID NO: 133

SEQ ID NO: 527 - DNA, 201 bp, Homo sapiens; identical to SEQ ID NO: 137

SEQ ID NO: 528 - DNA, 201 bp, Homo sapiens; identical to SEQ ID NO: 138

SEQ ID NO: 529 - DNA, 201 bp, Homo sapiens; identical to SEQ ID NO: 433

SEQ ID NO: 530 - DNA, 201 bp, Homo sapiens; identical to SEQ ID NO: 434

SEQ ID NO: 531 - DNA, 201 bp, Homo sapiens; identical to SEQ ID NO: 147

SEQ ID NO: 532 - DNA, 201 bp, Homo sapiens; identical to SEQ ID NO: 152

SEQ ID NO: 533 - DNA, 201 bp, Homo sapiens; identical to SEQ ID NO: 436

SEQ ID NO: 534 - DNA, 201 bp, Homo sapiens; identical to SEQ ID NO: 438

SEQ ID NO: 535 - DNA, 201 bp, Homo sapiens
actctgctaagctcttaggtccatgatctcatttaatcctctaaccactctcatgccaattgtgtagtggaggagaccgaagcttggacagatgaggcacrgattagaaccctgaagcttgggttctgaaccatgagacagtgttggtttttgtgtagttttatgtttgtatggttctttttttttttttctttttttttt

SEQ ID NO: 536 - DNA, 201 bp, Homo sapiens
gtcggtactcttcccttttccccatcctctgcatttcacaatattctcaggctgagcttaaaggcctgaagccttccctccttcaccagctggatctgggrttctgtgctttctctaagcttctcctactctcaatcataatgatctacttatctgctcatttcctccactgaactaagagtttcttgagtccagagtgca

SEQ ID NO: 537 - DNA, 201 bp, Homo sapiens
ctcacctgggccaggaggcctagaatgagagactttctgggctggaaggaaacttaaaagtcttcaaatccaacccccaatttgaagtcctagtggagccstctgggtttgcttgttcacctccaatgacgagcctggacagactgcattcaaactggcaccccatcccttccacccggtcctgtttctgaccctggagaa

SEQ ID NO: 538 - DNA, 201 bp, Homo sapiens; identical to SEQ ID NO: 440

SEQ ID NO: 539 - DNA, 201 bp, Homo sapiens; identical to SEQ ID NO: 172

SEQ ID NO: 540 - DNA, 201 bp, Homo sapiens; identical to SEQ ID NO: 173

SEQ ID NO: 541 - DNA, 201 bp, Homo sapiens; identical to SEQ ID NO: 180

SEQ ID NO: 542 - DNA, 201 bp, Homo sapiens; identical to SEQ ID NO: 441

SEQ ID NO: 543 - DNA, 201 bp, Homo sapiens; identical to SEQ ID NO: 189

SEQ ID NO: 544 - DNA, 201 bp, Homo sapiens; identical to SEQ ID NO: 443

SEQ ID NO: 545 - DNA, 201 bp, Homo sapiens; identical to SEQ ID NO: 429

SEQ ID NO: 546 - DNA, 201 bp, Homo sapiens; identical to SEQ ID NO: 444

SEQ ID NO: 547 - DNA, 201 bp, Homo sapiens; identical to SEQ ID NO: 445

SEQ ID NO: 548 - DNA, 201 bp, Homo sapiens; identical to SEQ ID NO: 77

SEQ ID NO: 549 - DNA, 201 bp, Homo sapiens; identical to SEQ ID NO: 437

SEQ ID NO: 550 - DNA, 201 bp, Homo sapiens; identical to SEQ ID NO: 439

SEQ ID NO: 551 - DNA, 201 bp, Homo sapiens; identical to SEQ ID NO: 451

SEQ ID NO: 552 - DNA, 201 bp, Homo sapiens
aagtcactgtacatatctcatataatcaacacttgtcattctcaaagctcaagactggttcaagattacaccctatgaaatacaaaacaaaacccaaaaarcagtttcaacatctcttacctgtacagagaagtccatctttgtagtaaagtgcatacactctggcactgtgtccaattaatgacgaggtttcaaaggctt

SEQ ID NO: 553 - DNA, 201 bp, Homo sapiens
gatgccactaatcttgtgaataatgctgcattgaatgtggggagtgcagatatctctttaacatactgatttaatatcttttggatatatttccagtagcrgaattgctagattgtgtggcagttctatttttaattttgtgaggaacctccataatggctgtattattggtttaccataatggctcattgtggttttact

SEQ ID NO: 554 - DNA, 201 bp, Homo sapiens
tgcttgatagcacagtccaataatatagacaataagagagacacatatccagtagatggtagagcatggccaaggttccaagcatcctgacttcatttagrgtacttgaaacatgggaaataaaaattgattatgtggggtggaagtcaactacggtgtcctaaaagtaaggtctcaagagagcaaatttgatttgctaag

SEQ ID NO: 555 - DNA, 201 bp, Homo sapiens
acagagggaaagagagaaagaaagagaaagaaagaaaagaaagaaagagaaagaaagagataagtaaagataggaattgtgattctccaatggttaagagygagctttggggctgggcacggtggctctcacctgtaatcccagcactttggaaggccgaggcaggtggatcacctgagatcaggagtttgaaaccagcct

SEQ ID NO: 556 - DNA, 201 bp, Homo sapiens
tttatatacatacacacacacacacacacacacacacacacacacacacacatacacacacacacatatatacatacatggaatggagttattcagccttraaaaggaataaaattggccgggtgtggtggctcacacctgtaatcccaacactttgggaggccgaggcgggaggatcacctgaggtcaggagtttgagac

SEQ ID NO: 557 - DNA, 201 bp, Homo sapiens; identical to SEQ ID NO: 552

SEQ ID NO: 558 - DNA, 201 bp, Homo sapiens; identical to SEQ ID NO: 553

SEQ ID NO: 559 - DNA, 201 bp, Homo sapiens; identical to SEQ ID NO: 554

SEQ ID NO: 560 - DNA, 201 bp, Homo sapiens; identical to SEQ ID NO: 555

SEQ ID NO: 561 - DNA, 201 bp, Homo sapiens
ctaaactgccactttttaacggacacttttttccttctgccttcacagagtgcaaataaaacacttcatgttgtaaattgatgagagcagtcctgcctggrtggggcaagacagaaaggctggaagtttagtctcaaaaacacatgctattcagttgcagcagcactttttaggggtaacagtaggccaaattgaaaagtc

SEQ ID NO: 562 - DNA, 201 bp, Homo sapiens
cagctgatttactttcagatctattaaccttagcactactggaaatcatgtggagtaataaatccactcatcactgagattttattattgtaaagttcaamagataactggatttcctctgctgagaatctgactgtgagtcataagcattatcctacacaataagaaaggatgggctaaggaattactgaaatacctaaa

SEQ ID NO: 563 - DNA, 201 bp, Homo sapiens; identical to SEQ ID NO: 296

SEQ ID NO: 564 - DNA, 201 bp, Homo sapiens
gatccctggacaagggaaatggaacttatagctaagatgctgtggataaagctggctttacaaataatcagaatagatgactccaatgtcatgttctttgmggggtcctggaaaggaccacccagccctctaaattgctttcactgccatcctgcctgaaattccatctttagaaacactgtaattcctctggatcactaa

SEQ ID NO: 565 - DNA, 201 bp, Homo sapiens; identical to SEQ ID NO: 300

SEQ ID NO: 566 - DNA, 201 bp, Homo sapiens
aaggcaaacacttaacaatgttatttactccagggggatttttatctccctgcctgcttcctttttctttgaacaaatgtttttgtatacctactatgtayttgatactgggctactacagtgaagaaggacacaatctctattttcaaaagtgtggtctaaaggccaggcttggtagctcatgcctgttgtcccagcact

SEQ ID NO: 567 - DNA, 201 bp, Homo sapiens
aaaaaagaagccaaaaataagtaagagatgggtggtatggatggaatgatgacccacttgctccgaagttggaactgttaatttgaccttaatatggaatygggagaataagtatggtacacacagtcataaaagaatgaggtaactctacatgtactgatacgtccatagatattaatattaaatgaaaaaagcagagcg

SEQ ID NO: 568 - DNA, 201 bp, Homo sapiens; identical to SEQ ID NO: 309

SEQ ID NO: 569 - DNA, 201 bp, Homo sapiens
caaaaagaataaggaaagtaaataagcataaatgtcttatttcctaaatattttaaggattttctgtagttttcctgcattcaaatgtttcaggccatacmagaggaaaaaaataggtgagagcaacagcaataattttaaatttggacctctcagtctaaaataatgctgcaatagccctttacccttttaaaacaacat

SEQ ID NO: 570 - DNA, 201 bp, Homo sapiens
gaagtaggagtttgttgactagctggtaggcaggaagggttttctagttagcaacttagcaaggacagctttgtgaaggagcatggaacatccaggcaacrtgagtggaccagttaggagctactgaaatattcccatcaaaatacaggggcgtacccctggggcaagatgactctctgacgtccacttactactattctc

SEQ ID NO: 571 - DNA, 201 bp, Homo sapiens
tggaaacccaaactgcacaaatcaatcagtttctccctgcagccctgttgatgaaaactggaagagttcaagaaatagttatgtaaaatttaaataaagtycatgttcttttttgtgggtatttgtgtgcttaagtaatgtaagtatcataatccctaagaaaatactttctaacttttaaacattgttcactataaaatt

SEQ ID NO: 572 - DNA, 201 bp, Homo sapiens; identical to SEQ ID NO: 365

SEQ ID NO: 573 - DNA, 201 bp, Homo sapiens; identical to SEQ ID NO: 366

SEQ ID NO: 574 - DNA, 201 bp, Homo sapiens; identical to SEQ ID NO: 367

SEQ ID NO: 575 - DNA, 201 bp, Homo sapiens; identical to SEQ ID NO: 368

SEQ ID NO: 576 - DNA, 201 bp, Homo sapiens; identical to SEQ ID NO: 369

SEQ ID NO: 577 - DNA, 201 bp, Homo sapiens; identical to SEQ ID NO: 370

SEQ ID NO: 578 - DNA, 201 bp, Homo sapiens
acatctgcaagtcctcaaggagacaagacctgcccccttatcacctcttcgggggagagagtgggcctatcccatctgcagggaaagaatgaacacattgyttttattttccaaggtgtgttcctgtaaatgaaacaattcactgctatgcaacttttaggattggccacttgagagcaggccttgtactggacaatgggg

SEQ ID NO: 579 - DNA, 201 bp, Homo sapiens; identical to SEQ ID NO: 372

SEQ ID NO: 580 - DNA, 201 bp, Homo sapiens; identical to SEQ ID NO: 373

SEQ ID NO: 581 - DNA, 201 bp, Homo sapiens; identical to SEQ ID NO: 374

SEQ ID NO: 582 - DNA, 201 bp, Homo sapiens; identical to SEQ ID NO: 375

SEQ ID NO: 583 - DNA, 201 bp, Homo sapiens; identical to SEQ ID NO: 376

SEQ ID NO: 584 - DNA, 201 bp, Homo sapiens
gaaaaatgtagagatgtgggtacagatttgtataaaggctggttgtcgaagccttacttatgctaaaaaatagaactaacctaaatatccaatggggattrtttaaatgaattatgattcaaccttccacagagattagaatcatgctcttgaagaacactgatgatgtaaaaagtctgctaacatattaagtgagaaagc

SEQ ID NO: 585 - DNA, 20 bp, Homo sapiens
gcggagacttcatcctgatg

SEQ ID NO: 586 - DNA, 20 bp, Homo sapiens
gcggagacttcatcctgatt

SEQ ID NO: 587 - DNA, 20 bp, Homo sapiens
ccgctttggtctggatgtga

SEQ ID NO: 588 - DNA, 16 bp, Homo sapiens
ttcctgacatgcccca

SEQ ID NO: 589 - DNA, 15 bp, Homo sapiens
tcctgacatgccccg

SEQ ID NO: 590 - DNA, 21 bp, Homo sapiens
tgtccccctgccttgacttat

SEQ ID NO: 591 - DNA, 22 bp, Homo sapiens
gcttcccaaaagactaatgcta

SEQ ID NO: 592 - DNA, 22 bp, Homo sapiens
gcttcccaaaagactaatgctg

SEQ ID NO: 593 - DNA, 26 bp, Homo sapiens
ggataattttgccagatcgccttcta

SEQ ID NO: 594 - DNA, 25 bp, Homo sapiens
cctcggtcatcaatgcttataatta

SEQ ID NO: 595 - DNA, 25 bp, Homo sapiens
cctcggtcatcaatgcttataattt

SEQ ID NO: 596 - DNA, 27 bp, Homo sapiens
cagcacgaattattccagctttctttg

SEQ ID NO: 597 - DNA, 16 bp, Homo sapiens
tgggaaattcaaggcg

SEQ ID NO: 598 - DNA, 17 bp, Homo sapiens
ctgggaaattcaaggca

SEQ ID NO: 599 - DNA, 26 bp, Homo sapiens
tttaagtcctgggtaaactaaataga

SEQ ID NO: 600 - DNA, 22 bp, Homo sapiens
gaaaacagctttacagacaagc

SEQ ID NO: 601 - DNA, 23 bp, Homo sapiens
agaaaacagctttacagacaagt

SEQ ID NO: 602 - DNA, 22 bp, Homo sapiens
ggaagccacagaaaggcatcag

SEQ ID NO: 603 - DNA, 27 bp, Homo sapiens
gcccaatgaataataatcacaaaagtt

SEQ ID NO: 604 - DNA, 27 bp, Homo sapiens
gcccaatgaataataatcacaaaagtc

SEQ ID NO: 605 - DNA, 25 bp, Homo sapiens
agcaatgctgtggaaggagagatat

SEQ ID NO: 606 - DNA, 19 bp, Homo sapiens
agagaaggtgtgtccaaca

SEQ ID NO: 607 - DNA, 18 bp, Homo sapiens
gagaaggtgtgtccaacg

SEQ ID NO: 608 - DNA, 23 bp, Homo sapiens
agaggtgagcacttcgctctatc

SEQ ID NO: 609 - DNA, 16 bp, Homo sapiens
actccgcaggcatcat

SEQ ID NO: 610 - DNA, 16 bp, Homo sapiens
actccgcaggcatcac

SEQ ID NO: 611 - DNA, 26 bp, Homo sapiens
ggaagcaaagtggagtgtgaacaata

SEQ ID NO: 612 - DNA, 22 bp, Homo sapiens
caaacctgatcactttagggaa

SEQ ID NO: 613 - DNA, 22 bp, Homo sapiens
caaacctgatcactttagggag

SEQ ID NO: 614 - DNA, 20 bp, Homo sapiens
ggagaatgcggctcacactc

SEQ ID NO: 615 - DNA, 22 bp, Homo sapiens
gggaagtctttctggattgttg

SEQ ID NO: 616 - DNA, 22 bp, Homo sapiens
gggaagtctttctggattgttc

SEQ ID NO: 617 - DNA, 23 bp, Homo sapiens
ccatagctgctctgaagggactg

SEQ ID NO: 618 - DNA, 18 bp, Homo sapiens
ctttctgtcttgccccat

SEQ ID NO: 619 - DNA, 18 bp, Homo sapiens
ctttctgtcttgccccac

SEQ ID NO: 620 - DNA, 29 bp, Homo sapiens
aggatgggctaaggaattactgaaatacc

SEQ ID NO: 621 - DNA, 22 bp, Homo sapiens
gcagaggaaatccagttatctt

SEQ ID NO: 622 - DNA, 22 bp, Homo sapiens
gcagaggaaatccagttatctg

SEQ ID NO: 623 - DNA, 23 bp, Homo sapiens
ccgttccccatcagctgatttac

SEQ ID NO: 624 - DNA, 21 bp, Homo sapiens
gccacacaatctagcaattct

SEQ ID NO: 625 - DNA, 21 bp, Homo sapiens
gccacacaatctagcaattcc

SEQ ID NO: 626 - DNA, 24 bp, Homo sapiens
tcatgcactggtggacacttagat

SEQ ID NO: 627 - DNA, 21 bp, Homo sapiens
ccaaggagtctacactctcaa

SEQ ID NO: 628 - DNA, 21 bp, Homo sapiens
ccaaggagtctacactctcac

SEQ ID NO: 629 - DNA, 19 bp, Homo sapiens
gaggtggcatgcaaacaca

SEQ ID NO: 630 - DNA, 26 bp, Homo sapiens
ggttctttacttgcttcagttattat

SEQ ID NO: 631 - DNA, 26 bp, Homo sapiens
ggttctttacttgcttcagttattac

SEQ ID NO: 632 - DNA, 26 bp, Homo sapiens
atgtccaggggattcaagaatgagta

SEQ ID NO: 633 - DNA, 18 bp, Homo sapiens
ccaccactggcctatgat

SEQ ID NO: 634 - DNA, 18 bp, Homo sapiens
ccaccactggcctatgaa

SEQ ID NO: 635 - DNA, 27 bp, Homo sapiens
gtaatgctgctttacctcagctagaac

SEQ ID NO: 636 - DNA, 28 bp, Homo sapiens
gccagtcttggattcatcttatatacta

SEQ ID NO: 637 - DNA, 27 bp, Homo sapiens
ccagtcttggattcatcttatatactg

SEQ ID NO: 638 - DNA, 18 bp, Homo sapiens
agcgaggctccgtctcaa

SEQ ID NO: 639 - DNA, 22 bp, Homo sapiens
tcagccttagaacaatgctatg

SEQ ID NO: 640 - DNA, 23 bp, Homo sapiens
gtcagccttagaacaatgctata

SEQ ID NO: 641 - DNA, 24 bp, Homo sapiens
gctctgctcccaagattttctgtt

SEQ ID NO: 642 - DNA, 17 bp, Homo sapiens
ggagctccccattttgg

SEQ ID NO: 643 - DNA, 18 bp, Homo sapiens
aggagctccccattttga

SEQ ID NO: 644 - DNA, 23 bp, Homo sapiens
ccactagccaggcaggataagat

SEQ ID NO: 645 - DNA, 20 bp, Homo sapiens
actgctcagtgtctttccaa

SEQ ID NO: 646 - DNA, 20 bp, Homo sapiens
actgctcagtgtctttccat

SEQ ID NO: 647 - DNA, 20 bp, Homo sapiens
cctggggagctctgagtgat

SEQ ID NO: 648 - DNA, 21 bp, Homo sapiens
cttttgcaagtgaggcataga

SEQ ID NO: 649 - DNA, 20 bp, Homo sapiens
ttttgcaagtgaggcatagt

SEQ ID NO: 650 - DNA, 20 bp, Homo sapiens
gctgctccgtggagtaactc

SEQ ID NO: 651 - DNA, 20 bp, Homo sapiens
acagaatgatgtagctgtcg

SEQ ID NO: 652 - DNA, 21 bp, Homo sapiens
tacagaatgatgtagctgtca

SEQ ID NO: 653 - DNA, 20 bp, Homo sapiens
tcctgcagatctggagaatc

SEQ ID NO: 654 - DNA, 21 bp, Homo sapiens
aacacatttgagtgggtacac

SEQ ID NO: 655 - DNA, 22 bp, Homo sapiens
aaacacatttgagtgggtacat

SEQ ID NO: 656 - DNA, 26 bp, Homo sapiens
ctgacacaccatcctcattggtttag

SEQ ID NO: 657 - DNA, 19 bp, Homo sapiens
ccataccttgttccggaaa

SEQ ID NO: 658 - DNA, 19 bp, Homo sapiens
ccataccttgttccggaag

SEQ ID NO: 659 - DNA, 24 bp, Homo sapiens
aatggagatggcactggaaagaga

SEQ ID NO: 660 - DNA, 18 bp, Homo sapiens
tgcctcaagtgctttacg

SEQ ID NO: 661 - DNA, 19 bp, Homo sapiens
gtgcctcaagtgctttaca

SEQ ID NO: 662 - DNA, 24 bp, Homo sapiens
aacgtcagcctcagtgactacttt

SEQ ID NO: 663 - DNA, 24 bp, Homo sapiens
cttgggaaagtcattagtacaaac

SEQ ID NO: 664 - DNA, 24 bp, Homo sapiens
cttgggaaagtcattagtacaaag

SEQ ID NO: 665 - DNA, 25 bp, Homo sapiens
tccttcaaggtaagcatctgagtgt

SEQ ID NO: 666 - DNA, 23 bp, Homo sapiens
gggaaatcttgttggatagtctg

SEQ ID NO: 667 - DNA, 23 bp, Homo sapiens
gggaaatcttgttggatagtctt

SEQ ID NO: 668 - DNA, 25 bp, Homo sapiens
gcagctctccttgactaggagtaat

SEQ ID NO: 669 - DNA, 23 bp, Homo sapiens
ttctgatgactgatcaaacagac

SEQ ID NO: 670 - DNA, 23 bp, Homo sapiens
ttctgatgactgatcaaacagat

SEQ ID NO: 671 - DNA, 31 bp, Homo sapiens
gctgagattcagtacttcaagtttaacacat

SEQ ID NO: 672 - DNA, 20 bp, Homo sapiens
tgccctttatttacatgacg

SEQ ID NO: 673 - DNA, 21 bp, Homo sapiens
gtgccctttatttacatgaca

SEQ ID NO: 674 - DNA, 21 bp, Homo sapiens
aaaaggcaattcacaaaagag

SEQ ID NO: 675 - DNA, 26 bp, Homo sapiens
cctatggagatatgaactggtaaaat

SEQ ID NO: 676 - DNA, 26 bp, Homo sapiens
cctatggagatatgaactggtaaaac

SEQ ID NO: 677 - DNA, 27 bp, Homo sapiens
acgagtggagtcattgaattgtagcta

SEQ ID NO: 678 - DNA, 21 bp, Homo sapiens
tctcagtgcaaactgttcaac

SEQ ID NO: 679 - DNA, 21 bp, Homo sapiens
tctcagtgcaaactgttcaat

SEQ ID NO: 680 - DNA, 26 bp, Homo sapiens
ccttcagtgcttcctcaaagcttaat

SEQ ID NO: 681 - DNA, 26 bp, Homo sapiens
gctaattgaaagctaatgattccttg

SEQ ID NO: 682 - DNA, 26 bp, Homo sapiens
gctaattgaaagctaatgattccttc

SEQ ID NO: 683 - DNA, 22 bp, Homo sapiens
atggtgtttccctgcctctgta

SEQ ID NO: 684 - DNA, 20 bp, Homo sapiens
ttgaacccctgtcaaagatg

SEQ ID NO: 685 - DNA, 24 bp, Homo sapiens
catattgaacccctgtcaaagatt

SEQ ID NO: 686 - DNA, 26 bp, Homo sapiens
cccactatgattggtgtagctgtaga

SEQ ID NO: 687 - DNA, 18 bp, Homo sapiens
gaccagttggtaggaggg

SEQ ID NO: 688 - DNA, 19 bp, Homo sapiens
tgaccagttggtaggagga

SEQ ID NO: 689 - DNA, 24 bp, Homo sapiens
cgtcactccagatgggagattaag

SEQ ID NO: 690 - DNA, 23 bp, Homo sapiens
caggtaagagatgttgaaactgt

SEQ ID NO: 691 - DNA, 22 bp, Homo sapiens
aggtaagagatgttgaaactgc

SEQ ID NO: 692 - DNA, 23 bp, Homo sapiens
ggggaaccactcaggattagaga

SEQ ID NO: 693 - DNA, 24 bp, Homo sapiens
acaaccagatttgatcatcatcaa

SEQ ID NO: 694 - DNA, 23 bp, Homo sapiens
caaccagatttgatcatcatcac

SEQ ID NO: 695 - DNA, 23 bp, Homo sapiens
tctcctctgctgccttcatttct

SEQ ID NO: 696 - DNA, 16 bp, Homo sapiens
ctcctcctggctctca

SEQ ID NO: 697 - DNA, 15 bp, Homo sapiens
tcctcctggctctcg

SEQ ID NO: 698 - DNA, 21 bp, Homo sapiens
ctggagcagaacctgtcagac

SEQ ID NO: 699 - DNA, 20 bp, Homo sapiens
ggttctaaccccatctttcc

SEQ ID NO: 700 - DNA, 20 bp, Homo sapiens
ggttctaaccccatctttca

SEQ ID NO: 701 - DNA, 24 bp, Homo sapiens
cttggcagtgtagaaggctgaaac

SEQ ID NO: 702 - DNA, 18 bp, Homo sapiens
tcctccactaccctcaga

SEQ ID NO: 703 - DNA, 17 bp, Homo sapiens
cctccactaccctcagg

SEQ ID NO: 704 - DNA, 25 bp, Homo sapiens
gtctccaccttcacgatgtttacat

SEQ ID NO: 705 - DNA, 24 bp, Homo sapiens
tcaggacaagaatctcatttcatt

SEQ ID NO: 706 - DNA, 25 bp, Homo sapiens
ttcaggacaagaatctcatttcata

SEQ ID NO: 707 - DNA, 30 bp, Homo sapiens
tatgagcctttcacatacgtgtattacaga

SEQ ID NO: 708 - DNA, 20 bp, Homo sapiens
gcaaagagctgagagaatcc

SEQ ID NO: 709 - DNA, 20 bp, Homo sapiens
gcaaagagctgagagaatca

SEQ ID NO: 710 - DNA, 25 bp, Homo sapiens
gacagacacaaggaccatcctgata

SEQ ID NO: 711 - DNA, 18 bp, Homo sapiens
ctgcaggtatttggggaa

SEQ ID NO: 712 - DNA, 18 bp, Homo sapiens
ctgcaggtatttggggac

SEQ ID NO: 713 - DNA, 25 bp, Homo sapiens
gtatgggaagagcttcacctactgt

SEQ ID NO: 714 - DNA, 23 bp, Homo sapiens
ccaaacttacctggctgtttata

SEQ ID NO: 715 - DNA, 22 bp, Homo sapiens
caaacttacctggctgtttatg

SEQ ID NO: 716 - DNA, 25 bp, Homo sapiens
gtgttttgcctgggttttgaagaac

SEQ ID NO: 717 - DNA, 23 bp, Homo sapiens
ctcataagaaggtcacatgtcat

SEQ ID NO: 718 - DNA, 23 bp, Homo sapiens
ctcataagaaggtcacatgtcac

SEQ ID NO: 719 - DNA, 24 bp, Homo sapiens
atgtatgccatgccacttttgtca

SEQ ID NO: 720 - DNA, 22 bp, Homo sapiens
tgttcattctgtgtaccttcag

SEQ ID NO: 721 - DNA, 22 bp, Homo sapiens
tgttcattctgtgtaccttcac

SEQ ID NO: 722 - DNA, 26 bp, Homo sapiens
ggctatttcctgccatctctgtaaac

SEQ ID NO: 723 - DNA, 23 bp, Homo sapiens
gctttcagataacagacaaacac

SEQ ID NO: 724 - DNA, 24 bp, Homo sapiens
agctttcagataacagacaaacat

SEQ ID NO: 725 - DNA, 22 bp, Homo sapiens
ctgatgagcggcttcggttaaa

SEQ ID NO: 726 - DNA, 19 bp, Homo sapiens
caatggggacaatctcagc

SEQ ID NO: 727 - DNA, 20 bp, Homo sapiens
acaatggggacaatctcagt

SEQ ID NO: 728 - DNA, 30 bp, Homo sapiens
attcatagatgagggtatttctggtgttga

SEQ ID NO: 729 - DNA, 19 bp, Homo sapiens
ccctgctgacaccttaatc

SEQ ID NO: 730 - DNA, 19 bp, Homo sapiens
ccctgctgacaccttaatg

SEQ ID NO: 731 - DNA, 24 bp, Homo sapiens
cgggattaaggggacagttctatc

SEQ ID NO: 732 - DNA, 20 bp, Homo sapiens
ccacctcctagcttgtagag

SEQ ID NO: 733 - DNA, 20 bp, Homo sapiens
ccacctcctagcttgtagat

SEQ ID NO: 734 - DNA, 23 bp, Homo sapiens
gggtctcaggagaactcgattgt

SEQ ID NO: 735 - DNA, 26 bp, Homo sapiens
acttaacatcctgttatcacattctg

SEQ ID NO: 736 - DNA, 27 bp, Homo sapiens
cacttaacatcctgttatcacattcta

SEQ ID NO: 737 - DNA, 17 bp, Homo sapiens
gcacccggccttgactt

SEQ ID NO: 738 - DNA, 20 bp, Homo sapiens
gtagtagggtcctgacttga

SEQ ID NO: 739 - DNA, 20 bp, Homo sapiens
gtagtagggtcctgacttgt

SEQ ID NO: 740 - DNA, 22 bp, Homo sapiens
gagagaagcctgggcaatactg

SEQ ID NO: 741 - DNA, 17 bp, Homo sapiens
ggggaacctccgtctgt

SEQ ID NO: 742 - DNA, 16 bp, Homo sapiens
gggaacctccgtctgc

SEQ ID NO: 743 - DNA, 23 bp, Homo sapiens
aaagttttgcttcatcaactaca

SEQ ID NO: 744 - DNA, 18 bp, Homo sapiens
gccagctgacaaacactg

SEQ ID NO: 745 - DNA, 19 bp, Homo sapiens
ggccagctgacaaacacta

SEQ ID NO: 746 - DNA, 19 bp, Homo sapiens
ccaaggtcagcggctcaaa

SEQ ID NO: 747 - DNA, 18 bp, Homo sapiens
tgccccagatgtgttttc

SEQ ID NO: 748 - DNA, 18 bp, Homo sapiens
tgccccagatgtgttttg

SEQ ID NO: 749 - DNA, 24 bp, Homo sapiens
tgagctggattcctggtggataag

SEQ ID NO: 750 - DNA, 22 bp, Homo sapiens
tgagtgtgagaaaggagatctg

SEQ ID NO: 751 - DNA, 23 bp, Homo sapiens
ctgagtgtgagaaaggagatcta

SEQ ID NO: 752 - DNA, 23 bp, Homo sapiens
gctctgatgcttgggaaagtcat

SEQ ID NO: 753 - DNA, 21 bp, Homo sapiens
ggaggtgaccttggattatct

SEQ ID NO: 754 - DNA, 21 bp, Homo sapiens
ggaggtgaccttggattatcc

SEQ ID NO: 755 - DNA, 23 bp, Homo sapiens
ttgtggtcccttcctccatcttc

SEQ ID NO: 756 - DNA, 21 bp, Homo sapiens
gttccaagaacatgcatttgg

SEQ ID NO: 757 - DNA, 22 bp, Homo sapiens
agttccaagaacatgcatttgt

SEQ ID NO: 758 - DNA, 21 bp, Homo sapiens
ctctgagctggtccctctcat

SEQ ID NO: 759 - DNA, 20 bp, Homo sapiens
gagaccattatcagctcacg

SEQ ID NO: 760 - DNA, 20 bp, Homo sapiens
gagaccattatcagctcacc

SEQ ID NO: 761 - DNA, 23 bp, Homo sapiens
gagggccagggttctaaattgta

SEQ ID NO: 762 - DNA, 22 bp, Homo sapiens
actttcacagtggtttcagatc

SEQ ID NO: 763 - DNA, 22 bp, Homo sapiens
actttcacagtggtttcagatt

SEQ ID NO: 764 - DNA, 21 bp, Homo sapiens
cccagggcccacagttagtaa

SEQ ID NO: 765 - DNA, 23 bp, Homo sapiens
cttttcttattagagcaggttgg

SEQ ID NO: 766 - DNA, 23 bp, Homo sapiens
cttttcttattagagcaggttgc

SEQ ID NO: 767 - DNA, 23 bp, Homo sapiens
tccttcccctggtttgggataaa

SEQ ID NO: 768 - DNA, 23 bp, Homo sapiens
caacctgtgaacatgagaatact

SEQ ID NO: 769 - DNA, 22 bp, Homo sapiens
aacctgtgaacatgagaatacc

SEQ ID NO: 770 - DNA, 25 bp, Homo sapiens
ggtgttgtttgcctctatcacatct

SEQ ID NO: 771 - DNA, 19 bp, Homo sapiens
tccaagcctcactttgtgt

SEQ ID NO: 772 - DNA, 18 bp, Homo sapiens
ccaagcctcactttgtgc

SEQ ID NO: 773 - DNA, 23 bp, Homo sapiens
ctgctgtatgaacttgggtctgg

SEQ ID NO: 774 - DNA, 23 bp, Homo sapiens
cttcatcttggaatgctcaaaag

SEQ ID NO: 775 - DNA, 23 bp, Homo sapiens
cttcatcttggaatgctcaaaat

SEQ ID NO: 776 - DNA, 34 bp, Homo sapiens
accattagactagttaagatcactaaggatgtga

SEQ ID NO: 777 - DNA, 21 bp, Homo sapiens
ggctacttgtgagttctttgg

SEQ ID NO: 778 - DNA, 21 bp, Homo sapiens
ggctacttgtgagttctttga

SEQ ID NO: 779 - DNA, 28 bp, Homo sapiens
ggtatttggcaactgttaactttgtgga

SEQ ID NO: 780 - DNA, 24 bp, Homo sapiens
ggaacagatgatttcaatggtctc

SEQ ID NO: 781 - DNA, 24 bp, Homo sapiens
ggaacagatgatttcaatggtctt

SEQ ID NO: 782 - DNA, 29 bp, Homo sapiens
gtttcttacaagcataaaggtgccttaca

SEQ ID NO: 783 - DNA, 26 bp, Homo sapiens
ccagtagaggtaaatgaagaactttg

SEQ ID NO: 784 - DNA, 26 bp, Homo sapiens
ccagtagaggtaaatgaagaactttc

SEQ ID NO: 785 - DNA, 26 bp, Homo sapiens
ctgtttaggacatagctgacactcaa

SEQ ID NO: 786 - DNA, 20 bp, Homo sapiens
catgtgcaggtctgttgtac

SEQ ID NO: 787 - DNA, 20 bp, Homo sapiens
catgtgcaggtctgttgtat

SEQ ID NO: 788 - DNA, 24 bp, Homo sapiens
gtggagggtgagagaagggtaaag

SEQ ID NO: 789 - DNA, 24 bp, Homo sapiens
gcaaatgtaggactcttgatgtta

SEQ ID NO: 790 - DNA, 23 bp, Homo sapiens
caaatgtaggactcttgatgttg

SEQ ID NO: 791 - DNA, 26 bp, Homo sapiens
cgaacagagcctagcaaatggtaaat

SEQ ID NO: 792 - DNA, 19 bp, Homo sapiens
gcctggggcttataaaagg

SEQ ID NO: 793 - DNA, 19 bp, Homo sapiens
gcctggggcttataaaagt

SEQ ID NO: 794 - DNA, 22 bp, Homo sapiens
ggcaaacaacaggcaaatgtga

SEQ ID NO: 795 - DNA, 19 bp, Homo sapiens
tgaggagacaaagtggctc

SEQ ID NO: 796 - DNA, 19 bp, Homo sapiens
tgaggagacaaagtggctg

SEQ ID NO: 797 - DNA, 27 bp, Homo sapiens
agtgatagggaatttgtagccgtcttt

SEQ ID NO: 798 - DNA, 21 bp, Homo sapiens
ttgctttaactcccttgtagc

SEQ ID NO: 799 - DNA, 22 bp, Homo sapiens
cttgctttaactcccttgtagt

SEQ ID NO: 800 - DNA, 22 bp, Homo sapiens
caggctcggatgaacctcaaag

SEQ ID NO: 801 - DNA, 21 bp, Homo sapiens
tgggttgaagcctcaattcta

SEQ ID NO: 802 - DNA, 20 bp, Homo sapiens
gggttgaagcctcaattctg

SEQ ID NO: 803 - DNA, 30 bp, Homo sapiens
cgcaattatttggacaaatgaggaaacatg

SEQ ID NO: 804 - DNA, 24 bp, Homo sapiens
tccttagccctttaattggatttg

SEQ ID NO: 805 - DNA, 24 bp, Homo sapiens
tccttagccctttaattggatttc

SEQ ID NO: 806 - DNA, 27 bp, Homo sapiens
ttgcagaggaatcggaatcaggatatt

SEQ ID NO: 807 - DNA, 18 bp, Homo sapiens
tccatacctctgttcggc

SEQ ID NO: 808 - DNA, 19 bp, Homo sapiens
ttccatacctctgttcggt

SEQ ID NO: 809 - DNA, 22 bp, Homo sapiens
tcagggctacggtgatgtttca

SEQ ID NO: 810 - DNA, 17 bp, Homo sapiens
agctatccccctaccgt

SEQ ID NO: 811 - DNA, 16 bp, Homo sapiens
gctatccccctaccgc

SEQ ID NO: 812 - DNA, 23 bp, Homo sapiens
gacaggaaattcccctgaactct

SEQ ID NO: 813 - DNA, 19 bp, Homo sapiens
tggtcctactgtccctact

SEQ ID NO: 814 - DNA, 19 bp, Homo sapiens
tggtcctactgtccctaca

SEQ ID NO: 815 - DNA, 20 bp, Homo sapiens
gccctgttccttcctgtgtt

SEQ ID NO: 816 - DNA, 24 bp, Homo sapiens
gagtcagtcttttatgatcacact

SEQ ID NO: 817 - DNA, 24 bp, Homo sapiens
gagtcagtcttttatgatcacaca

SEQ ID NO: 818 - DNA, 29 bp, Homo sapiens
gctgcattgactatttgcgagatattttg

SEQ ID NO: 819 - DNA, 19 bp, Homo sapiens
ctgcacaaaggagaacaca

SEQ ID NO: 820 - DNA, 19 bp, Homo sapiens
ctgcacaaaggagaacact

SEQ ID NO: 821 - DNA, 22 bp, Homo sapiens
cgtactccaatctgggactaga

SEQ ID NO: 822 - DNA, 18 bp, Homo sapiens
ttgagctttgggcaagtc

SEQ ID NO: 823 - DNA, 19 bp, Homo sapiens
tttgagctttgggcaagtt

SEQ ID NO: 824 - DNA, 28 bp, Homo sapiens
tgtgactcctcacaacaacttatcatgt

SEQ ID NO: 825 - DNA, 22 bp, Homo sapiens
ctcctatccaagtgttaaccag

SEQ ID NO: 826 - DNA, 21 bp, Homo sapiens
tcctatccaagtgttaaccac

SEQ ID NO: 827 - DNA, 25 bp, Homo sapiens
ttaggaggctagcgtagcaatctag

SEQ ID NO: 828 - DNA, 24 bp, Homo sapiens
agcttaggaaacaccaaattaaac

SEQ ID NO: 829 - DNA, 27 bp, Homo sapiens
ataagcttaggaaacaccaaattaaat

SEQ ID NO: 830 - DNA, 27 bp, Homo sapiens
ttgatgtgtcataatgtgcgttagcat

SEQ ID NO: 831 - DNA, 22 bp, Homo sapiens
gtggagctcacaaaagagttat

SEQ ID NO: 832 - DNA, 21 bp, Homo sapiens
tggagctcacaaaagagttac

SEQ ID NO: 833 - DNA, 23 bp, Homo sapiens
tctctgttctcaacggctcagtt

SEQ ID NO: 834 - DNA, 26 bp, Homo sapiens
ttgatcactaaccttactcagtaaat

SEQ ID NO: 835 - DNA, 25 bp, Homo sapiens
tgatcactaaccttactcagtaaac

SEQ ID NO: 836 - DNA, 26 bp, Homo sapiens
agccctcagtaaatgttagccactag

SEQ ID NO: 837 - DNA, 27 bp, Homo sapiens
gcctcttcattaaaatcatcacatcat

SEQ ID NO: 838 - DNA, 27 bp, Homo sapiens
gcctcttcattaaaatcatcacatcaa

SEQ ID NO: 839 - DNA, 30 bp, Homo sapiens
gtgacattgtgttttccttgatttagaagc

SEQ ID NO: 840 - DNA, 20 bp, Homo sapiens
actactgtggctgtctgatc

SEQ ID NO: 841 - DNA, 20 bp, Homo sapiens
actactgtggctgtctgatg

SEQ ID NO: 842 - DNA, 24 bp, Homo sapiens
gctacaggaggggagactgattac

SEQ ID NO: 843 - DNA, 26 bp, Homo sapiens
ctttataggatgcaaatgctaatgag

SEQ ID NO: 844 - DNA, 26 bp, Homo sapiens
ctttataggatgcaaatgctaatgat

SEQ ID NO: 845 - DNA, 26 bp, Homo sapiens
ggcatcagaaagaacaaaggctaatt

SEQ ID NO: 846 - DNA, 23 bp, Homo sapiens
gggacttcattgatggaaatgta

SEQ ID NO: 847 - DNA, 23 bp, Homo sapiens
gggacttcattgatggaaatgtt

SEQ ID NO: 848 - DNA, 24 bp, Homo sapiens
tgagcgacgtttcagaagagtctt

SEQ ID NO: 849 - DNA, 18 bp, Homo sapiens
ggagctgtgacaatcgag

SEQ ID NO: 850 - DNA, 18 bp, Homo sapiens
ggagctgtgacaatcgaa

SEQ ID NO: 851 - DNA, 34 bp, Homo sapiens
actgtatgactccctttatgtactacaatacatg

SEQ ID NO: 852 - DNA, 20 bp, Homo sapiens
gcatggacatgagacagatt

SEQ ID NO: 853 - DNA, 20 bp, Homo sapiens
gcatggacatgagacagatg

SEQ ID NO: 854 - DNA, 22 bp, Homo sapiens
tgcttgaatcccctcctcacat

SEQ ID NO: 855 - DNA, 17 bp, Homo sapiens
gcagtcagtgcctatgc

SEQ ID NO: 856 - DNA, 18 bp, Homo sapiens
ggcagtcagtgcctatgt

SEQ ID NO: 857 - DNA, 32 bp, Homo sapiens
tccctccaccaaatacagtactatattctaca

SEQ ID NO: 858 - DNA, 19 bp, Homo sapiens
agagcctggtaaagaaggt

SEQ ID NO: 859 - DNA, 18 bp, Homo sapiens
gagcctggtaaagaaggc

SEQ ID NO: 860 - DNA, 18 bp, Homo sapiens
ggcatctgctggctgagt

SEQ ID NO: 861 - DNA, 21 bp, Homo sapiens
tgtaatagtgcatgaaggacg

SEQ ID NO: 862 - DNA, 23 bp, Homo sapiens
aatgtaatagtgcatgaaggaca

SEQ ID NO: 863 - DNA, 25 bp, Homo sapiens
gcaaaccaacatggcacatgtatac

SEQ ID NO: 864 - DNA, 18 bp, Homo sapiens
cggtgagaatgccatgga

SEQ ID NO: 865 - DNA, 18 bp, Homo sapiens
cggtgagaatgccatggt

SEQ ID NO: 866 - DNA, 28 bp, Homo sapiens
agccaaatttaccagaacagctaaactg

SEQ ID NO: 867 - DNA, 22 bp, Homo sapiens
tgattctccaatggttaagagc

SEQ ID NO: 868 - DNA, 23 bp, Homo sapiens
gtgattctccaatggttaagagt

SEQ ID NO: 869 - DNA, 20 bp, Homo sapiens
tgttggccaggctggtttca

SEQ ID NO: 870 - DNA, 25 bp, Homo sapiens
gtaaaccctacctaaaatgtactgg

SEQ ID NO: 871 - DNA, 25 bp, Homo sapiens
gtaaaccctacctaaaatgtactgt

SEQ ID NO: 872 - DNA, 23 bp, Homo sapiens
gaggagatggaggggatgatgac

SEQ ID NO: 873 - DNA, 22 bp, Homo sapiens
tcctccttgtagttaacaatgc

SEQ ID NO: 874 - DNA, 26 bp, Homo sapiens
gatatcctccttgtagttaacaatgt

SEQ ID NO: 875 - DNA, 27 bp, Homo sapiens
cagtcttacatgcttccaagaaactgg

SEQ ID NO: 876 - DNA, 26 bp, Homo sapiens
agtggatactactgattttagacaac

SEQ ID NO: 877 - DNA, 28 bp, Homo sapiens
gaagtggatactactgattttagacaat

SEQ ID NO: 878 - DNA, 28 bp, Homo sapiens
ggtgttactttggatcctaggggtattt

SEQ ID NO: 879 - DNA, 26 bp, Homo sapiens
gaaattcacttcagtaaacatgtact

SEQ ID NO: 880 - DNA, 26 bp, Homo sapiens
gaaattcacttcagtaaacatgtacc

SEQ ID NO: 881 - DNA, 22 bp, Homo sapiens
ggaggtgatggagccaagattc

SEQ ID NO: 882 - DNA, 25 bp, Homo sapiens
taccccattttccatgatatgatta

SEQ ID NO: 883 - DNA, 23 bp, Homo sapiens
ccccattttccatgatatgattg

SEQ ID NO: 884 - DNA, 33 bp, Homo sapiens
tttatgtgggtaaatagtatttacggggtacac

SEQ ID NO: 885 - DNA, 19 bp, Homo sapiens
tgacccagagtagaagctg

SEQ ID NO: 886 - DNA, 23 bp, Homo sapiens
gttatgacccagagtagaagcta

SEQ ID NO: 887 - DNA, 26 bp, Homo sapiens
gccagcaagcaagtaaagaaatgatt

SEQ ID NO: 888 - DNA, 24 bp, Homo sapiens
tgtacacataacaactgagaactg

SEQ ID NO: 889 - DNA, 24 bp, Homo sapiens
tgtacacataacaactgagaactc

SEQ ID NO: 890 - DNA, 28 bp, Homo sapiens
caataagccaatgatgctggtactatca

SEQ ID NO: 891 - DNA, 19 bp, Homo sapiens
cctgtgttatgttccaccg

SEQ ID NO: 892 - DNA, 20 bp, Homo sapiens
tcctgtgttatgttccacca

SEQ ID NO: 893 - DNA, 22 bp, Homo sapiens
gctgcacagcaggaaagagaat

SEQ ID NO: 894 - DNA, 18 bp, Homo sapiens
ggacagaattctgcaggc

SEQ ID NO: 895 - DNA, 19 bp, Homo sapiens
aggacagaattctgcaggt

SEQ ID NO: 896 - DNA, 26 bp, Homo sapiens
ctcaggacctcagaccactttagtta

SEQ ID NO: 897 - DNA, 17 bp, Homo sapiens
gcactagaccttgcccg

SEQ ID NO: 898 - DNA, 17 bp, Homo sapiens
gcactagaccttgccca

SEQ ID NO: 899 - DNA, 24 bp, Homo sapiens
actgttcccaagaccatgatcact

SEQ ID NO: 900 - DNA, 20 bp, Homo sapiens
atcatgatccggtctctcat

SEQ ID NO: 901 - DNA, 19 bp, Homo sapiens
tcatgatccggtctctcaa

SEQ ID NO: 902 - DNA, 25 bp, Homo sapiens
ggaatggggcatttggctatattgt

SEQ ID NO: 903 - DNA, 23 bp, Homo sapiens
catgtctcatttacctcctttct

SEQ ID NO: 904 - DNA, 23 bp, Homo sapiens
catgtctcatttacctcctttcc

SEQ ID NO: 905 - DNA, 25 bp, Homo sapiens
ccccttccagttctgtgatctatga

SEQ ID NO: 906 - DNA, 21 bp, Homo sapiens
caacctcacagatttggagac

SEQ ID NO: 907 - DNA, 21 bp, Homo sapiens
caacctcacagatttggagaa

SEQ ID NO: 908 - DNA, 28 bp, Homo sapiens
gttctcacagtaatctgctgaacaaact

SEQ ID NO: 909 - DNA, 25 bp, Homo sapiens
aagggtcatattgtctatttgagat

SEQ ID NO: 910 - DNA, 25 bp, Homo sapiens
aagggtcatattgtctatttgagac

SEQ ID NO: 911 - DNA, 21 bp, Homo sapiens
ccagcacttccactggttgtt

SEQ ID NO: 912 - DNA, 22 bp, Homo sapiens
aggggacttatatgacttgcat

SEQ ID NO: 913 - DNA, 21 bp, Homo sapiens
ggggacttatatgacttgcac

SEQ ID NO: 914 - DNA, 26 bp, Homo sapiens
gcttactgtccacctgaaggattaga

SEQ ID NO: 915 - DNA, 26 bp, Homo sapiens
catagagtataccatgttttgagact

SEQ ID NO: 916 - DNA, 25 bp, Homo sapiens
atagagtataccatgttttgagacc

SEQ ID NO: 917 - DNA, 30 bp, Homo sapiens
gcggctatgtattatagttgttaagcatga

SEQ ID NO: 918 - DNA, 23 bp, Homo sapiens
tgcatgaggtttacattcagatc

SEQ ID NO: 919 - DNA, 24 bp, Homo sapiens
ttgcatgaggtttacattcagata

SEQ ID NO: 920 - DNA, 29 bp, Homo sapiens
gaacactttaggaatggatggtttcaact

SEQ ID NO: 921 - DNA, 19 bp, Homo sapiens
ggtatgatgcccttgagaa

SEQ ID NO: 922 - DNA, 19 bp, Homo sapiens
ggtatgatgcccttgagac

SEQ ID NO: 923 - DNA, 21 bp, Homo sapiens
tttcccaacctggccattgac

SEQ ID NO: 924 - DNA, 21 bp, Homo sapiens
gtgacttgagtttctcaggag

SEQ ID NO: 925 - DNA, 21 bp, Homo sapiens
gtgacttgagtttctcaggaa

SEQ ID NO: 926 - DNA, 28 bp, Homo sapiens
ctcatcttaccactgataacacagttct

SEQ ID NO: 927 - DNA, 17 bp, Homo sapiens
cagacgcatgccactac

SEQ ID NO: 928 - DNA, 18 bp, Homo sapiens
acagacgcatgccactat

SEQ ID NO: 929 - DNA, 25 bp, Homo sapiens
acttgaacccaggagttcgagaata

SEQ ID NO: 930 - DNA, 24 bp, Homo sapiens
agcagaagacttgatgacctatta

SEQ ID NO: 931 - DNA, 23 bp, Homo sapiens
gcagaagacttgatgacctattt

SEQ ID NO: 932 - DNA, 25 bp, Homo sapiens
gccccaactgtattatgcagtttga

SEQ ID NO: 933 - DNA, 22 bp, Homo sapiens
gacccaaactattcacatggat

SEQ ID NO: 934 - DNA, 22 bp, Homo sapiens
gacccaaactattcacatggag

SEQ ID NO: 935 - DNA, 21 bp, Homo sapiens
ccagaggtcgccactgttaac

SEQ ID NO: 936 - DNA, 23 bp, Homo sapiens
catagttgttctctctgatcctc

SEQ ID NO: 937 - DNA, 23 bp, Homo sapiens
catagttgttctctctgatcctt

SEQ ID NO: 938 - DNA, 24 bp, Homo sapiens
tcctctgctgcaatctcctcatag

SEQ ID NO: 939 - DNA, 22 bp, Homo sapiens
ggctcataactgtagtcttagc

SEQ ID NO: 940 - DNA, 23 bp, Homo sapiens
tggctcataactgtagtcttagt

SEQ ID NO: 941 - DNA, 20 bp, Homo sapiens
gctgcagtgcattggtacaa

SEQ ID NO: 942 - DNA, 18 bp, Homo sapiens
aatctatggcagttgccc

SEQ ID NO: 943 - DNA, 19 bp, Homo sapiens
gaatctatggcagttgcct

SEQ ID NO: 944 - DNA, 26 bp, Homo sapiens
tctggggttgtcaaattgagagacat

SEQ ID NO: 945 - DNA, 22 bp, Homo sapiens
gtgtaccatacttattctcccg

SEQ ID NO: 946 - DNA, 23 bp, Homo sapiens
tgtgtaccatacttattctccca

SEQ ID NO: 947 - DNA, 25 bp, Homo sapiens
gagatgggtggtatggatggaatga

SEQ ID NO: 948 - DNA, 22 bp, Homo sapiens
actgtagtagcccagtatcaag

SEQ ID NO: 949 - DNA, 22 bp, Homo sapiens
actgtagtagcccagtatcaaa

SEQ ID NO: 950 - DNA, 25 bp, Homo sapiens
ccaacataaggctaaggcaaacact

SEQ ID NO: 951 - DNA, 23 bp, Homo sapiens
atccttttcccgtagaattgaat

SEQ ID NO: 952 - DNA, 23 bp, Homo sapiens
atccttttcccgtagaattgaaa

SEQ ID NO: 953 - DNA, 24 bp, Homo sapiens
gaagatctcaggggcctctaagag

SEQ ID NO: 954 - DNA, 20 bp, Homo sapiens
ctcctaactggtccactcat

SEQ ID NO: 955 - DNA, 19 bp, Homo sapiens
tcctaactggtccactcac

SEQ ID NO: 956 - DNA, 23 bp, Homo sapiens
gctgggttttgatggggaagtag

SEQ ID NO: 957 - DNA, 22 bp, Homo sapiens
cccatactccactaacaaggac

SEQ ID NO: 958 - DNA, 22 bp, Homo sapiens
cccatactccactaacaaggaa

SEQ ID NO: 959 - DNA, 26 bp, Homo sapiens
cttgcagaatgtcttaggggactagt

SEQ ID NO: 960 - DNA, 16 bp, Homo sapiens
gcctttgggaaacgcc

SEQ ID NO: 961 - DNA, 16 bp, Homo sapiens
gcctttgggaaacgct

SEQ ID NO: 962 - DNA, 23 bp, Homo sapiens
ccacccctttgaatcccatactc

SEQ ID NO: 963 - DNA, 18 bp, Homo sapiens
ggttttgcacaaggcatg

SEQ ID NO: 964 - DNA, 19 bp, Homo sapiens
gggttttgcacaaggcata

SEQ ID NO: 965 - DNA, 26 bp, Homo sapiens
gcacatgtgcaggatgagaaagatac

SEQ ID NO: 966 - DNA, 23 bp, Homo sapiens
gacagatgagaagtcacttcaac

SEQ ID NO: 967 - DNA, 23 bp, Homo sapiens
gacagatgagaagtcacttcaag

SEQ ID NO: 968 - DNA, 23 bp, Homo sapiens
gctgggattacatgcatgagtca

SEQ ID NO: 969 - DNA, 25 bp, Homo sapiens
tccttataaaatcagacagttctgc

SEQ ID NO: 970 - DNA, 25 bp, Homo sapiens
tccttataaaatcagacagttctgt

SEQ ID NO: 971 - DNA, 25 bp, Homo sapiens
gcctcaaagggaaacaagccttaat

SEQ ID NO: 972 - DNA, 21 bp, Homo sapiens
tcttcacaacagcagatacca

SEQ ID NO: 973 - DNA, 20 bp, Homo sapiens
cttcacaacagcagataccg

SEQ ID NO: 974 - DNA, 27 bp, Homo sapiens
caccaccctacttactagctttgagta

SEQ ID NO: 975 - DNA, 26 bp, Homo sapiens
tattttggtttcttggctcatataag

SEQ ID NO: 976 - DNA, 27 bp, Homo sapiens
ttattttggtttcttggctcatataaa

SEQ ID NO: 977 - DNA, 27 bp, Homo sapiens
agacccagtgattccaaccaatatcat

SEQ ID NO: 978 - DNA, 30 bp, Homo sapiens
gtaaaatttaaaagaactgaaatggaagag

SEQ ID NO: 979 - DNA, 30 bp, Homo sapiens
gtaaaatttaaaagaactgaaatggaagac

SEQ ID NO: 980 - DNA, 34 bp, Homo sapiens
gaagaattatatcactgcttctcatgaatctcac

SEQ ID NO: 981 - DNA, 20 bp, Homo sapiens
ctccagtgtgtctcatttgt

SEQ ID NO: 982 - DNA, 19 bp, Homo sapiens
tccagtgtgtctcatttgc

SEQ ID NO: 983 - DNA, 23 bp, Homo sapiens
gagattcagggacggaaagaagc

SEQ ID NO: 984 - DNA, 21 bp, Homo sapiens
ttcccttccagataacatcca

SEQ ID NO: 985 - DNA, 21 bp, Homo sapiens
ttcccttccagataacatcct

SEQ ID NO: 986 - DNA, 27 bp, Homo sapiens
ctgtaaggagccctaggaagaattatg

SEQ ID NO: 987 - DNA, 23 bp, Homo sapiens
gactccaatgtcatgttctttga

SEQ ID NO: 988 - DNA, 21 bp, Homo sapiens
ctccaatgtcatgttctttgc

SEQ ID NO: 989 - DNA, 23 bp, Homo sapiens
gtacccactcaggagctcttagt

SEQ ID NO: 990 - DNA, 19 bp, Homo sapiens
gagactcccatcacagagt

SEQ ID NO: 991 - DNA, 18 bp, Homo sapiens
agactcccatcacagagc

SEQ ID NO: 992 - DNA, 25 bp, Homo sapiens
accaaacccatctccactttacagt

SEQ ID NO: 993 - DNA, 21 bp, Homo sapiens
tgggatgagcaatcctgttat

SEQ ID NO: 994 - DNA, 20 bp, Homo sapiens
gggatgagcaatcctgttac

SEQ ID NO: 995 - DNA, 24 bp, Homo sapiens
acctcattaggccttgtgctatct

SEQ ID NO: 996 - DNA, 22 bp, Homo sapiens
acagcaacctgaaagattacag

SEQ ID NO: 997 - DNA, 22 bp, Homo sapiens
acagcaacctgaaagattacaa

SEQ ID NO: 998 - DNA, 24 bp, Homo sapiens
gttttgtgtgtgtgtgtgtgtgat

SEQ ID NO: 999 - DNA, 23 bp, Homo sapiens
caagcatcctgacttcatttaga

SEQ ID NO: 1000 - DNA, 22 bp, Homo sapiens
aagcatcctgacttcatttagg

SEQ ID NO: 1001 - DNA, 28 bp, Homo sapiens
gagaccttacttttaggacaccgtagtt

SEQ ID NO: 1002 - DNA, 20 bp, Homo sapiens
ctaaccacaacctaccacac

SEQ ID NO: 1003 - DNA, 20 bp, Homo sapiens
ctaaccacaacctaccacat

SEQ ID NO: 1004 - DNA, 25 bp, Homo sapiens
ttggaaccttcgattctccagatct

What is claimed is:

1. A method for determining that a human has an increased risk for rheumatoid arthritis (RA), comprising testing nucleic acid from said human to determine the nucleotide content at a polymorphism in gene TRAF1 as represented by position 101 of SEQ ID NO:504 or its complement, wherein the presence of C at position 101 of SEQ ID NO:504 or G at position 101 of its complement is detected and indicates that said human has said increased risk for RA.

2. The method of claim 1, wherein said nucleic acid is a nucleic acid extract from a biological sample from said human.

3. The method of claim 2, wherein said biological sample is blood, saliva, or buccal cells.

4. The method of claim 2, further comprising preparing said nucleic acid extract from said biological sample prior to said testing.

5. The method of claim 4, further comprising obtaining said biological sample from said human prior to said preparing.

6. The method of claim 1, wherein said testing comprises nucleic acid amplification.

7. The method of claim 6, wherein said nucleic acid amplification is carried out by polymerase chain reaction.

8. The method of claim 1, further comprising correlating the presence of said C or said G with said increased risk for RA.

9. The method of claim 8, wherein said correlating is performed by computer software.

10. The method of claim 1, wherein said testing is performed using sequencing, 5' nuclease digestion, molecular beacon assay, oligonucleotide ligation assay, size analysis, single-stranded conformation polymorphism analysis, or denaturing gradient gel electrophoresis (DGGE).

11. The method of claim 1, wherein said testing is performed using an allele-specific method.

12. The method of claim 11, wherein said allele-specific method is allele-specific probe hybridization, allele-specific primer extension, or allele-specific amplification.

13. The method of claim 11, wherein said allele-specific method detects said C or said G.

14. The method of claim 11, wherein said testing is carried out using an allele-specific primer that comprises a sequence selected from the group consisting of SEQ ID NOS:747-748 and sequences fully complementary thereto.

15. The method of claim 1, wherein said human is homozygous for said C or said G.

16. The method of claim 1, wherein said human is heterozygous for said C or said G.

17. A method of determining that a human has an increased risk for rheumatoid arthritis (RA), comprising:
   a) testing nucleic acid from said human to determine the nucleotide content at a polymorphism in gene TRAF1 as represented by position 101 of SEQ ID NO:504 or its complement; and
   b) correlating the presence of C at position 101 of SEQ ID NO:504 or G at position 101 of its complement with said human having said increased risk for RA.

18. The method of claim 17, wherein said correlating is performed by computer software.

19. The method of claim 17, wherein said nucleic acid is a nucleic acid extract from a biological sample from said human.

20. The method of claim 19, wherein said biological sample is blood, saliva, or buccal cells.

21. The method of claim 19, further comprising preparing said nucleic acid extract from said biological sample prior to said testing.

22. The method of claim 21, further comprising obtaining said biological sample from said human prior to said preparing.

23. The method of claim 17, wherein said testing comprises nucleic acid amplification.

24. The method of claim 23, wherein said nucleic acid amplification is carried out by polymerase chain reaction.

25. The method of claim 17, wherein said testing is performed using sequencing, 5' nuclease digestion, molecular beacon assay, oligonucleotide ligation assay, size analysis, single-stranded conformation polymorphism analysis, or denaturing gradient gel electrophoresis (DGGE).

26. The method of claim 17, wherein said testing is performed using an allele-specific method.

27. The method of claim 26, wherein said allele-specific method is allele-specific probe hybridization, allele-specific primer extension, or allele-specific amplification.

28. The method of claim 26, wherein said allele-specific method detects said C or said G.

29. The method of claim 26, wherein said testing is carried out using an allele-specific primer that comprises a sequence selected from the group consisting of SEQ ID NOS:747-748 and sequences fully complementary thereto.

30. The method of claim 17, wherein said human is homozygous for said C or said G.

31. The method of claim 17, wherein said human is heterozygous for said C or said G.

* * * * *